US010258655B2

(12) United States Patent
Henn et al.

(10) Patent No.: US 10,258,655 B2
(45) Date of Patent: Apr. 16, 2019

(54) SYNERGISTIC BACTERIAL COMPOSITIONS AND METHODS OF PRODUCTION AND USE THEREOF

(71) Applicant: Seres Therapeutics, Inc., Cambridge, MA (US)

(72) Inventors: Matthew R. Henn, Somerville, MA (US); Kevin Daniel Litcofsky, Boston, MA (US); Anthony Mario D'Onofrio, Northborough, MA (US); Toshiro K. Ohsumi, Cambridge, MA (US); Mary-Jane Lombardo McKenzie, Arlington, MA (US); Geoffrey von Maltzahn, Boston, MA (US); David N. Cook, Brooklyn, NY (US); David Arthur Berry, Brookline, MA (US); Noubar B. Afeyan, Lexington, MA (US); John Grant Aunins, Doylestown, PA (US)

(73) Assignee: Seres Therapeutics, Inc., Cambridge, MA (US)

( * ) Notice: Subject to any disclaimer, the term of this patent is extended or adjusted under 35 U.S.C. 154(b) by 0 days.

(21) Appl. No.: 15/039,007

(22) PCT Filed: Nov. 25, 2014

(86) PCT No.: PCT/US2014/067491
§ 371 (c)(1),
(2) Date: May 24, 2016

(87) PCT Pub. No.: WO2015/077794
PCT Pub. Date: May 28, 2015

(65) Prior Publication Data
US 2017/0151291 A1    Jun. 1, 2017

Related U.S. Application Data

(60) Provisional application No. 61/908,702, filed on Nov. 25, 2013, provisional application No. 61/908,698, filed on Nov. 25, 2013, provisional application No. 62/004,187, filed on May 28, 2014.

(51) Int. Cl.
| | |
|---|---|
| *A61K 39/02* | (2006.01) |
| *A61K 35/742* | (2015.01) |
| *A61K 35/74* | (2015.01) |
| *C12N 1/20* | (2006.01) |
| *A23L 33/135* | (2016.01) |
| *A61K 45/06* | (2006.01) |
| *A61K 35/00* | (2006.01) |

(52) U.S. Cl.
CPC ......... *A61K 35/742* (2013.01); *A23L 33/135* (2016.08); *A61K 35/74* (2013.01); *A61K 45/06* (2013.01); *C12N 1/20* (2013.01); *A61K 2035/11* (2013.01); *A61K 2035/115* (2013.01); *Y02A 50/402* (2018.01); *Y02A 50/473* (2018.01); *Y02A 50/475* (2018.01); *Y02A 50/478* (2018.01); *Y02A 50/479* (2018.01); *Y02A 50/481* (2018.01)

(58) Field of Classification Search
None
See application file for complete search history.

(56) References Cited

U.S. PATENT DOCUMENTS

| | | |
|---|---|---|
| 3,009,864 A | 11/1961 | Gordon-Aldterton et al. |
| 3,228,838 A | 1/1966 | Rinfret |
| 3,608,030 A | 11/1971 | Grant |
| 4,077,227 A | 3/1978 | Larson |
| 4,205,132 A | 5/1980 | Sandine |
| 4,655,047 A | 4/1987 | Temple |
| 4,689,226 A | 8/1987 | Nurmi |
| 4,839,281 A | 6/1989 | Gorbach et al. |
| 5,196,205 A | 3/1993 | Borody |
| 5,425,951 A | 6/1995 | Goodrich |
| 5,436,002 A | 7/1995 | Payne |
| 5,443,826 A | 8/1995 | Borody |
| 5,599,795 A | 2/1997 | McCann |
| 5,648,206 A | 7/1997 | Goodrich |
| 5,951,977 A | 9/1999 | Nisbet et al. |
| 5,965,128 A | 10/1999 | Doyle et al. |
| 6,589,771 B1 | 7/2003 | Marshall |
| 6,645,530 B1 | 11/2003 | Borody |
| 7,427,398 B2 | 9/2008 | Baillon et al. |
| 7,628,982 B2 | 12/2009 | Klaviniskis |
| 7,632,520 B2 | 12/2009 | Khandelwal |
| 7,708,988 B2 | 5/2010 | Farmer |
| 7,731,976 B2 | 6/2010 | Cobb |
| 7,763,420 B2 | 7/2010 | Stritzker et al. |
| 7,981,411 B2 | 7/2011 | Nadeau et al. |
| 7,998,473 B2 | 8/2011 | Boileau et al. |
| 8,021,654 B2 | 9/2011 | Rehberger et al. |
| 8,034,601 B2 | 10/2011 | Boileau |
| 8,039,006 B2 | 10/2011 | Prato |
| 8,147,482 B2 | 4/2012 | Shimizu |
| 8,187,590 B2 | 5/2012 | Farmer |

(Continued)

FOREIGN PATENT DOCUMENTS

| | | |
|---|---|---|
| CN | 102131928 A | 7/2011 |
| EA | 006847 B1 | 4/2006 |

(Continued)

OTHER PUBLICATIONS

Petrof E. et al. Stool Substitute Transplant Therapy for the Eradication of C. diff infection. Microbiome 1(1)1-12, Jan. 2013.*

(Continued)

*Primary Examiner* — Jennifer E Graser
(74) *Attorney, Agent, or Firm* — Fenwick & West LLP

(57) ABSTRACT

Provided are therapeutic compositions containing microbial populations for prevention, treatment and reduction of symptoms associated with a dysbiosis of a mammalian subject such as a human.

14 Claims, 7 Drawing Sheets
Specification includes a Sequence Listing.

(56) References Cited

U.S. PATENT DOCUMENTS

| | | |
|---|---|---|
| 8,236,508 B2 | 8/2012 | Mutharasan |
| 8,388,996 B2 | 3/2013 | Gehling |
| 8,460,648 B2 | 6/2013 | Borody |
| 8,906,668 B2 | 12/2014 | Henn et al. |
| 9,011,834 B1 | 4/2015 | McKenzie et al. |
| 9,028,841 B2 | 5/2015 | Henn et al. |
| 9,180,147 B2 | 11/2015 | McKenzie et al. |
| 9,408,872 B2 | 8/2016 | Borody |
| 9,446,080 B2 | 9/2016 | McKenzie et al. |
| 9,808,519 B2 | 11/2017 | Honda et al. |
| 2001/0036453 A1 | 11/2001 | Reid |
| 2004/0028689 A1 | 2/2004 | Borody |
| 2004/0170617 A1 | 9/2004 | Finegold |
| 2005/0048515 A1 | 3/2005 | Garner |
| 2005/0180962 A1 | 8/2005 | Raz |
| 2006/0046246 A1 | 3/2006 | Zeng et al. |
| 2006/0188523 A1 | 8/2006 | Pei |
| 2006/0233830 A1 | 10/2006 | Wong |
| 2007/0141139 A1 | 6/2007 | Vandenberg |
| 2008/0213752 A1 | 9/2008 | Stave et al. |
| 2009/0197249 A1 | 8/2009 | Gillevet |
| 2010/0074872 A1 | 3/2010 | Blaser et al. |
| 2010/0215745 A1 | 8/2010 | Lazzari et al. |
| 2011/0081320 A1 | 4/2011 | Westall et al. |
| 2011/0113863 A1 | 5/2011 | Fuhrmann et al. |
| 2011/0189132 A1 | 8/2011 | Garner et al. |
| 2011/0280840 A1 | 11/2011 | Blaser |
| 2012/0020950 A1 | 1/2012 | Davis et al. |
| 2012/0021429 A1 | 1/2012 | Rublee |
| 2012/0021921 A1 | 1/2012 | Scott |
| 2012/0058094 A1 | 3/2012 | Blaser |
| 2012/0064592 A1 | 3/2012 | O'Mullan et al. |
| 2012/0128633 A1 | 5/2012 | Veiga et al. |
| 2012/0128634 A1 | 5/2012 | Veiga |
| 2012/0148629 A1 | 6/2012 | Holvoet et al. |
| 2012/0149584 A1 | 6/2012 | Olle |
| 2012/0165215 A1 | 6/2012 | Andersen |
| 2012/0177650 A1 | 7/2012 | Borody |
| 2012/0207726 A1 | 8/2012 | Lipkin |
| 2012/0238468 A1 | 9/2012 | Tuk |
| 2012/0264637 A1 | 10/2012 | Brodie |
| 2012/0276149 A1 | 11/2012 | Littman |
| 2012/0276201 A1 | 11/2012 | Trachtman |
| 2012/0315249 A1 | 12/2012 | Olmstead |
| 2013/0017999 A1 | 1/2013 | Fremont |
| 2013/0022575 A1 | 1/2013 | Cassity |
| 2013/0045274 A1 | 2/2013 | Hlavka |
| 2013/0045874 A1 | 2/2013 | Ehrlich |
| 2013/0121968 A1 | 5/2013 | Quay |
| 2013/0149339 A1 | 6/2013 | Honda |
| 2013/0149375 A1 | 6/2013 | Geall |
| 2013/0266539 A1 | 10/2013 | Borody |
| 2014/0045744 A1 | 2/2014 | Gordon |
| 2014/0147417 A1 | 5/2014 | Sadowsky et al. |
| 2014/0147425 A1 | 5/2014 | Henn et al. |
| 2014/0199281 A1 | 7/2014 | Henn et al. |
| 2014/0342438 A1 | 11/2014 | Allen-Vercoe et al. |
| 2015/0190435 A1 | 7/2015 | Henn et al. |
| 2016/0271188 A1 | 9/2016 | Berry et al. |

FOREIGN PATENT DOCUMENTS

| | | |
|---|---|---|
| EP | 0033584 A3 | 1/1981 |
| EP | 0446069 A1 | 9/1991 |
| EP | 0456418 A2 | 11/1991 |
| EP | 0433299 A4 | 4/1992 |
| EP | 1107772 B1 | 4/2006 |
| EP | 1631312 B1 | 9/2008 |
| EP | 2337569 A2 | 6/2011 |
| EP | 2338989 A1 | 6/2011 |
| EP | 2519108 A1 | 11/2012 |
| EP | 2684469 A1 | 1/2014 |
| EP | 0479820 B1 | 7/2014 |
| EP | 2626076 A1 | 8/2014 |
| EP | 2750682 B1 | 5/2016 |
| JP | 6-56679 A | 3/1994 |
| JP | 2007-332083 A | 12/2007 |
| JP | 2010-539179 T | 12/2010 |
| JP | 5 019563 B2 | 9/2012 |
| RU | 2035186 C1 | 5/1995 |
| RU | 2439145 C2 | 1/2012 |
| WO | WO 90/01335 A1 | 2/1990 |
| WO | WO 1997/009886 A1 | 3/1997 |
| WO | WO 98/26787 A1 | 6/1998 |
| WO | WO 2000/010582 A2 | 3/2000 |
| WO | WO 01/93904 A1 | 12/2001 |
| WO | WO 2002/007741 A1 | 1/2002 |
| WO | WO 02/43649 A2 | 6/2002 |
| WO | WO 2005/017095 A2 | 2/2005 |
| WO | WO 2005/110445 A2 | 11/2005 |
| WO | WO 2006/012586 A2 | 2/2006 |
| WO | WO 2007/036230 A1 | 4/2007 |
| WO | WO 2007/136553 A2 | 11/2007 |
| WO | WO 2008/076696 A2 | 6/2008 |
| WO | WO 2008/083157 A2 | 7/2008 |
| WO | WO 2010/030997 A1 | 3/2010 |
| WO | WO 2010/062369 A2 | 6/2010 |
| WO | WO 2010/124387 A1 | 11/2010 |
| WO | WO 2010/151842 A2 | 12/2010 |
| WO | WO 2011/005756 A1 | 1/2011 |
| WO | WO 2011/022542 A2 | 2/2011 |
| WO | WO 2011022660 A1 | 2/2011 |
| WO | WO 2011/033310 A1 | 3/2011 |
| WO | WO 2011/043654 A1 | 4/2011 |
| WO | WO 2011/046616 A3 | 4/2011 |
| WO | WO 2011/060123 A1 | 5/2011 |
| WO | WO 2011/094027 A1 | 8/2011 |
| WO | WO 2011/103123 A2 | 8/2011 |
| WO | WO 2011/107481 A2 | 9/2011 |
| WO | WO 2011/107482 A2 | 9/2011 |
| WO | WO 2011/113801 A1 | 9/2011 |
| WO | WO 2011/152566 A2 | 12/2011 |
| WO | WO 2012/009712 A2 | 1/2012 |
| WO | WO 2012/016287 A2 | 2/2012 |
| WO | WO 2012/033814 A2 | 3/2012 |
| WO | WO 2012/045150 A1 | 4/2012 |
| WO | WO 2012/064981 A2 | 5/2012 |
| WO | WO 2012/108830 A1 | 8/2012 |
| WO | WO 2012/116289 A2 | 8/2012 |
| WO | WO 2012/122478 A1 | 9/2012 |
| WO | WO 2012/122522 A2 | 9/2012 |
| WO | WO 2012/142605 A1 | 10/2012 |
| WO | WO 2012/148991 A1 | 11/2012 |
| WO | WO 2012/159023 A2 | 11/2012 |
| WO | WO 2013/019896 A1 | 2/2013 |
| WO | WO 2013/032328 A1 | 3/2013 |
| WO | WO 2013/037067 A1 | 3/2013 |
| WO | WO 2013/037068 | 3/2013 |
| WO | WO 2013/050792 A1 | 4/2013 |
| WO | WO 2013/053836 A1 | 4/2013 |
| WO | WO 2013/080561 A1 | 6/2013 |
| WO | WO 2013/166031 A1 | 11/2013 |
| WO | WO 2013/171515 A1 | 11/2013 |
| WO | WO 2013/176774 A1 | 11/2013 |
| WO | WO 2014/082050 A1 | 5/2014 |
| WO | WO 2015/095241 A2 | 6/2014 |
| WO | WO 2014/121298 A2 | 8/2014 |
| WO | WO 2014/121301 A1 | 8/2014 |
| WO | WO 2014/121302 A2 | 8/2014 |
| WO | WO 2014/121304 A1 | 8/2014 |
| WO | WO 2014/145958 A2 | 9/2014 |
| WO | WO 2014/153194 A2 | 9/2014 |
| WO | WO 2015/077794 A1 | 5/2015 |

OTHER PUBLICATIONS

Plassart et al (Anaerobe 19 (2013) 77-78).*
Australian First Examination Report, Australian Application No. 2013347805, dated Apr. 13, 2017, 3 pages.
Chiu, C-H. et al., "Rapid Identification of Salmonella Serovars in Feces by Specific Detection of Virulence Genes, invA and spvC, by an Enrichment Broth Culture-Multiplex PCR Combination Assay,"

(56) References Cited

OTHER PUBLICATIONS

Journal of Clinical Microbiology, Oct. 1996, pp. 2619-2622, vol. 34, No. 10.
Coleman, W.H., "Mechanism of Killing Spores of Bacillus Cereus and Bacillus Megaterium by Wet Heat," The Society for Applied Microbiology, Letters in Applied Microbiology, 2010. pp. 507-514, vol. 50.
Dendukuri, N., "Probiotic Therapy for the Prevention and Treatment of Clostridium Difficile-Associated Diarrhea: A Systematic Review," Canadian Medical Association Journal, Jul. 19, 2005, pp. 167-170, vol. 173, No. 2.
European Extended Search Report, European Application No. 14746341.8, dated Sep. 28, 2016, 10 pages.
European Partial Supplementary Report, European Application No. 14745792.3, dated Sep. 20, 2016, 11 pages.
European Partial Supplementary Report, European Application No. 14745749.3, dated Oct. 14, 2016, 6 pages.
European Extended Search Report, European Application No. 14746455.6, dated Nov. 24, 2016, 10 pages.
European Extended Search Report, European Application No. 14745792.3, dated Dec. 23, 2016, 17 pages.
European Extended Search Report, European Application No. 14745749.3, dated Jan. 23, 2017, 13 pages.
European Extended Search Report, European Application No. 13856249.1, dated Jan. 26, 2017, 19 pages.
Israel Office Action, Israel Application No. 238973, dated Apr. 20, 2017, 4 pages (with concise explanation of relevance).
Janda, J.M. et al., "16S rRNA Gene Sequencing for Bacterial Identification in the Diagnostic Laboratory: Pluses, Perils and Pitfalls," Journal of Clinical Microbiology, Sep. 2007, pp. 2761-2764, vol. 45, No. 9.
Johnson, S. et al., "Is Primary Prevention of Clostridium Difficile Infection Possible with Specific Probiotics?" International Journal of Infectious Diseases, Nov. 2012, pp. e786-e792, vol. 16, No. 11.
McFarland, L.V. et al., "Pharmaceutical Probiotics for the Treatment of Anaerobic and Other Infections," Anaerobe, Jan. 1997, pp. 73-78, vol. 3, No. 2-3.
New Zealand Third Examination Report, New Zealand Application No. 711771, dated Nov. 4, 2016, 4 pages.
Russian First Office Action, Russian Patent Application No. 2015124366, dated Dec. 13, 2016, 12 pages.
Russian Second Office Action, Russian Patent Application No. 2015137399, dated Mar. 14, 2017, 8 pages.
Setlow, B. et al., "Mechanisms of Killing Spores of Bacillus Subtilis by Acid, Alkali and Ethanol," Journal of Applied Microbiology, 2002, pp. 362-375, vol. 92.
United States Office Action, U.S. Appl. No. 14/777,252, dated Nov. 3, 2016, 16 pages.
United States Office Action, U.S. Appl. No. 14/765,810, dated Jan. 23, 2017, 20 pages.
United States Office Action, U.S. Appl. No. 14/776,676, dated Mar. 23, 2017, 9 pages.
United States Office Action, U.S. Appl. No. 14/777,252, dated May 11, 2017, 9 pages.
European Examination Report, European Application No. 14746341.8, dated Jun. 13, 2017, 11 pages.
New Zealand First Examination Report, New Zealand Application No. 713298, dated Feb. 28, 2017, 6 pages.
Aas, J., Gessert, C.E., and Bakken, J.S. (2003). Recurrent Clostridium difficile colitis: case series involving 18 patients treated with donor stool administered via a nasogastric tube. Clinical Infectious Diseases 36(5), 580-585.
Abrams, R.S., "Open-Label, Uncontrolled Trial of Bowel Sterilization and Repopulation with Normal Bowel Flora for Treatment of Inflammatory Bowel Disease," Current Therapeutic Research, Dec. 1997, pp. 1001-1012, vol. 58, No. 12.
Achtman, M., and Wagner, M. (2008). Microbial diversity and the genetic nature of microbial species. Nat. Rev. Microbiol. 6(6), 431-440.

Accoceberry, I. et al., "One-Step Purification of Enterocytozoon Bieneusi Spores from Human Stools by Immunoaffinity Expanded-Bed Adsorption," Journal of Clinical Microbiology, May 2001, pp. 1974-1951, vol. 39, No. 5.
Allen-Vercoe, E., Reid, G., Viner, N., Gloor, G.B., Hota, S., Kim, P., Lee, C., O'Doherty, K., Vanner, S.J., Weese, J.S., et al. (2012). A Canadian Working Group report on fecal microbial therapy: microbial ecosystems therapeutics. Can. J. Gastroenterol. 26(7), 457-462.
Allen-Vercoe, E., Strauss, J., and Chadee, K. (2011). Fusobacterium nucleatum: an emerging gut pathogen? Gut Microbes 2(5), 294-298.
Anderson, K.F., Lonsway, D.R., Rasheed, J.K., Biddle, J., Jensen, B., McDougal, L.K., Carey, R.B., Thompson, A., Stocker, S., Limbago, B., et al. (2007). Evaluation of Methods to Identify the Klebsiella pneumoniae Carbapenemase in Enterobacteriaceae. J. Clin. Microbiol. 45(8), 2723-2725.
Arumugam, M., Raes, J., Pelletier, E., Paslier, D.L., Yamada, T., Mende, D.R., Fernandes, G.R., Tap, J., Bruls, T., Batto, J.-M., et al. (2011). Enterotypes of the human gut microbiome. Nature 473(7346), 174-180.
Atarashi, K., Tanoue, T., Oshima, K., Suda, W., Nagano, Y., Nishikawa, H., Fukuda, S., Saito, T., Narushima, S., Hase, K., et al. (2013). Treg induction by a rationally selected mixture of Clostridia strains from the human microbiota. Nature 500(7461), 232-236.
Atarashi, K., Tanoue, T., Shima, T., Imaoka, A., Kuwahara, T., Momose, Y., Cheng, G., Yamasaki, S., Saito, T., Ohba, Y., et al. (2011). Induction of colonic regulatory T cells by indigenous *Clostridium* species. Science 331(6015), 337-341.
Backhed, F. et al., (2004). The gut microbiota as an environmental factor that regulates fat storage, PNAS, Nov. 2, 2014, pp. 15718-15723, vol. 101, No. 44.
Bader, J., Albin, A., and Stahl, U. (2012). Spore-forming bacteria and their utilisation as probiotics. Benef Microbes 3(1), 67-75.
Bakken, J.S. (2009). Fecal bacteriotherapy for recurrent Clostridium difficile infection. Anaerobe 15(6), 285-289.
Bakken, J.S., Borody, T., Brandt, L.J., Brill, J.V., Demarco, D.C., Franzos, M.A., Kelly, C., Khoruts, A., Louie, T., Martinelli, L.P., et al. (2011). Treating Clostridium difficile infection with fecal microbiota transplantation. Clin. Gastroenterol. Hepatol. 9(12), 1044-1049.
Barreau, M., Pagnier, I., and La Scola, B. (2013). Improving the identification of anaerobes in the clinical microbiology laboratory through MALDI-TOF mass spectrometry. Anaerobe 22, 123-125.
Bauer, T.M. et al., "Derivation and Validation of Guidelines for Stool Cultures for Enteropathogenic Bacteria Other Than Clostridium difficile in Hospitalized Adults," The Journal of the American Medical Association, Jan. 17, 2001, pp. 313-319, vol. 285.
Ben-Amor, K., Heilig, H., Smidt, H., Vaughan, E.E., Abee, T., and De Vos, W.M. (2005). Genetic diversity of viable, injured, and dead fecal bacteria assessed by fluorescence-activated cell sorting and 16S rRNA gene analysis. Applied and Environmental Microbiology 71(8), 4679-4689.
Berstad, A. et al., "Fecal Fat Determination with a Modified Titration Method," Scandinavian Journal of Gastroenterology, 2010, pp. 603-607, vol. 45.
Bhatia, A. et al., "Proionibacterium Acnes and Chronic Diseases," The Infectious Etiology of Chronic Diseases: Defining the Relationship, Enhancing the Research, and Mitigating the Effects: Workshop Summary., Knobler, S.L. et al. (eds.), 2004, pp. 74-80, may be downloaded at<URL:http://www.nap.edu/catalog/11026.html>.
Bidawid, S., Farber, J.M., Sattar, S.A., and Hayward, S. (2000). Heat inactivation of hepatitis A virus in dairy foods. J. Food Prot. 63(4), 522-528.
Bloedt, K., Riecker, M., Poppert, S., and Wellinghausen, N. (2009). Evaluation of new selective culture media and a rapid fluorescence in situ hybridization assay for identification of Clostridium difficile from stool samples. J Med Microbiol 58(7), 874-877.
Bokulich, N.A., Subramanian, S., Faith, J.J., Gevers, D., Gordon, J.I., Knight, R., Mills, D.A., and Caporaso, J.G. (2013). Quality-filtering vastly improves diversity estimates from Illumina amplicon sequencing. Nat Methods 10(1), 57-59.
Bolivar, I. et al., "Bacterial Diversity in Oral Samples of Children in Niger with Acute Noma, Acute Necrotizing Gingivitis and Healthy Controls," PLOS Neglected Tropical Diseases, Mar. 2012,

(56) References Cited

OTHER PUBLICATIONS pp. 1-11, vol. 6, No. 3, E1556; Uncultured *Catonella* sp. partial 16S rRNA Gene, Clone 402A04(oral): Nucleotide: NCBI: GenBank: AM420133.1, last accessed Mar. 12, 2014, pp. 12-13.

Borody, T.J. et al. (2011). Fecal microbiota transplantation (FMT) in multiple sclerosis. Poster abstract at American College of Gastroenterology Annual Scientific Meeting and Postgraduate Course Oct. 28, 2011.

Borody, T.J., and Khoruts, A. (2012). Fecal microbiota transplantation and emerging applications. Nat Rev Gastroenterol Hepatol 9(2), 88-96.

Borriello, S.P. (1990). The influence of the normal flora on Clostridium difficile colonisation of the gut. Ann. Med. 22(1), 61-67.

Borriello, S.P., and Barclay, F.E. (1985). Protection of hamsters against Clostridium difficile ileocaecitis by prior colonisation with non-pathogenic strains. J Med Microbiol 19(3), 339-350.

Borriello, S.P., and Barclay, F.E. (1986). An in-vitro model of colonisation resistance to Clostridium difficile infection. Journal of Medical Microbiology 21(4), 299-309.

Borriello, S.P., and Honour, P. (1981). Simplified procedure for the routine isolation of Clostridium difficile from faeces. J Clin Pathol 34(10), 1124-1127.

Boyles, W.A., and Lincoln, R.E. (1958). Separation and concentration of bacterial spores and vegetative cells by foam flotation. Appl Microbiol 6(5), 327-334.

Brandt, L.J. (2012). Fecal Transplantation for the Treatment of Clostridium difficile Infection. Gastroenterol Hepatol (N Y) 8(3), 191-194.

Brandt, L.J., Aroniadis, O.C., Mellow, M., Kanatzar, A., Kelly, C., Park, T., Stollman, N., Rohlke, F., and Surawicz, C. (2012). Long-Term Follow-Up of Colonoscopic Fecal Microbiota Transplant for Recurrent Clostridium difficile Infection. The American Journal of Gastroenterology 107(7), 1079-1087.

Bräuniger, S., Peters, J., Borchers, U., and Kao, M. (2000). Further studies on thermal resistance of bovine parvovirus against moist and dry heat. International Journal of Hygiene and Environmental Health 203(1), 71-75.

Broda, D.M., De Lacy, K.M., and Bell, R.G. (1998). Efficacy of heat and ethanol spore treatments for the isolation of psychrotrophic *Clostridium* spp. associated with the spoilage of chilled vacuum-packed meats. International Journal of Food Microbiology 39(1-2), 61-68.

Brosius, J. et al., "Complete Nucleotide Sequence of a 16S Ribosomal RNA Gene from *Eschericia coli*," Proc. Natl. Acad. Sci., Oct. 1978, pp. 4801-4805, vol. 75, No. 10.

Bueche, M., Wunderlin, T., Roussel-Delif, L., Junier, T., Sauvain, L., Jeanneret, N., and Junier, P. (2013). Quantification of Endospore-Forming Firmicutes by Quantitative PCR with the Functional Gene spo0A. Applied and Environmental Microbiology 79(17), 5302-5312.

Buffie, C.G., and Pamer, E.G. (2013). Microbiota-mediated colonization resistance against intestinal pathogens. Nature Reviews Immunology 13(11), 790-801.

Burke, C.J., Hsu, T.A., and Volkin, D.B. (1999). Formulation, stability, and delivery of live attenuated vaccines for human use. Crit Rev Ther Drug Carrier Syst 16(1), 1-83.

Cani, P.D., Possemiers, S., Wiele, T.V. De, Guiot, Y., Everard, A., Rottier, O., Geurts, L., Naslain, D., Neyrinck, A., Lambert, D.M., et al. (2009). Changes in gut microbiota control inflammation in obese mice through a mechanism involving GLP-2-driven improvement of gut permeability. Gut 58(8), 1091-1103.

Carvalho, A.S., Silva, J., Ho, P., Teixeira, P., Malcata, F.X., and Gibbs, P. (2008). Effects of Various Sugars Added to Growth and Drying Media upon Thermotolerance and Survival throughout Storage of Freeze-Dried *Lactobacillus delbrueckii* ssp. *bulgaricus*. Biotechnology Progress 20(1), 248-254.

Champagne, C.P., Mondou, F., Raymond, Y., and Roy, D. (1996). Effect of polymers and storage temperature on the stability of freeze-dried lactic acid bacteria. Food Research International 29(5-6), 555-562.

Chang, J.Y., Antonopoulos, D.A., Kalra, A., Tonelli, A., Khalife, W.T., Schmidt, T.M., and Young, V.B. (2008). Decreased diversity of the fecal Microbiome in recurrent Clostridium difficile-associated diarrhea. J. Infect. Dis. 197(3), 435-438.

Chapman, C.M.C., Gibson, G.R., and Rowland, I. (2012). In vitro evaluation of single- and multi-strain probiotics: Inter-species inhibition between probiotic strains, and inhibition of pathogens. Anaerobe 18(4), 405-413.

Chen, X., Katchar, K., Goldsmith, J.D., Nanthakumar, N., Cheknis, A., Gerding, D.N., and Kelly, C.P. (2008). A Mouse Model of Clostridium difficile—Associated Disease. Gastroenterology 135(6), 1984-1992.

Chow, J., Tang, H., and Mazmanian, S.K. (2011). Pathobionts of the Gastrointestinal Microbiota and Inflammatory Disease. Curr Opin Immunol 23(4), 473-480.

Claesson, M.J., Wang, Q., O'Sullivan, O., Greene-Diniz, R., Cole, J.R., Ross, R.P., and O'Toole, P.W. (2010). Comparison of two next-generation sequencing technologies for resolving highly complex microbiota composition using tandem variable 16S rRNA gene regions. Nucleic Acids Res 38(22), e200.

Clemente, J.C., Ursell, L.K., Parfrey, L.W., and Knight, R. (2012). The impact of the gut microbiota on human health: an integrative view. Cell 148(6), 1258-1270.

D'Souza, D.H., and Su, X. (2010). Efficacy of chemical treatments against murine norovirus, feline calicivirus, and MS2 bacteriophage. Foodborne Pathogens and Disease 7(3), 319-326.

David, L.A., Maurice, C.F., Carmody, R.N., Gootenberg, D.B., Button, J.E., Wolfe, B.E., Ling, A.V., Devlin, A.S., Varma, Y., Fischbach, M.A., et al. (2013). Diet rapidly and reproducibly alters the human gut microbiome. Nature advance online publication.

De Angelis, M., Piccolo, M., Vannini, L., Siragusa, S., De Giacomo, A., Serrazzanetti, D.I., Cristofori, F., Guerzoni, M.E., Gobbetti, M., and Francavilla, R. (2013). Fecal Microbiota and Metabolome of Children with Autism and Pervasive Developmental Disorder Not Otherwise Specified. PLoS One 8(10), e76993.

De Vos, W.M. (2013). Fame and future of faecal transplantations—developing next-generation therapies with synthetic microbiomes: Fame and future of faecal transplantations. Microbial Biotechnology 6(4), 316-325.

Defined Fecal Microbiota Transplantation for Clostridium Difficile Diarrhea. <http://clinicaltrials.gov/ct2/show/NCT01868373> Accessed Mar. 26, 2014.

Dezfulian, M. et al., "Selective Medium for Isolation of Clostridium botulinum from Human Feces," Journal of Clinical Microbiology, Mar. 1981, pp. 526-531, vol. 13, No. 3.

Derrien, M. (2004). *Akkermansia muciniphila* gen. nov., sp. nov., a human intestinal mucin-degrading bacterium. International Journal of Systematic and Evolutionary Microbiology 54(5), 1469-1476.

Dethlefsen, L., Huse, S., Sogin, M.L., and Relman, D.A. (2008). The Pervasive Effects of an Antibiotic on the Human Gut Microbiota, as Revealed by Deep 16S rRNA Sequencing. PLoS Biology 6(11), e280.

Detmer, A., and Glenting, J. (2006). Live bacterial vaccines—a review and identification of potential hazards. Microb Cell Fact 5, 23.

Dharmani, P., De Simone, C., and Chadee, K. (2013). The Probiotic Mixture VSL#3 Accelerates Gastric Ulcer Healing by Stimulating Vascular Endothelial Growth Factor. PLoS One 8(3), e58671.

Dietrich, G., Collioud, A., and Rothen, S.A. (2008). Developing and Manufacturing Attenuated Live Bacterial Vaccines. <http://www.biopharminternational.com/biopharm/Vaccine+Manufacturing+Articles/Developing-and-Manufacturing-Attenuated-Live-Bacte/ArticleStandard/Article/detail/557306> Accessed Mar. 25, 2014.

Dowell, V.R. et al., "Coproexamination for Botulinal Toxin and Clostridium botulinum," JAMA, Oct. 24, 1977, pp. 1829-1832, vol. 238, No. 7.

Dragon, D.C., and Rennie, R.P. (2001). Evaluation of spore extraction and purification methods for selective recovery of viable Bacillus anthracis spores. Lett. Appl. Microbiol. 33(2), 100-105.

Duc, L. (2003). Germination of the spore in the gastrointestinal tract provides a novel route for heterologous antigen delivery. Vaccine 21(27-30), 4215-4224.

(56) References Cited

OTHER PUBLICATIONS

Duc, L.H., Hong, H.A., Fairweather, N., Ricca, E., and Cutting, S.M. (2003). Bacterial Spores as Vaccine Vehicles. Infection and Immunity 71(5), 2810-2818.
Dumas, M.E. et al., (2006). Metabolic profiling reveals a contribution of gut microbiota to fatty liver phenotype in insulin-resistant mice, PNAS, Aug. 15, 2006, pp. 12511-12516, vol. 103, No. 33.
Dutta, S.K., Girotra, M., Garg, S., Dutta, A., Von Rosenvinge, E.C., Maddox, C., Song, Y., Bartlett, J.G., Vinayek, R., and Fricke, W.F. (2014). Efficacy of Combined Jejunal and Colonic Fecal Microbiota Transplantation for Recurrent Clostridium difficile Infection. Clinical Gastroenterology and Hepatology.
Edwards, A.D., and Slater, N.K.H. (2008). Formulation of a live bacterial vaccine for stable room temperature storage results in loss of acid, bile and bile salt resistance. Vaccine 26(45), 5675-5678.
Eiseman, B., Silen, W., Bascom, G.S., and Kauvar, A.J. (1958). Fecal enema as an adjunct in the treatment of pseudomembranous enterocolitis. Surgery 44(5), 854-859.
Elving, J., Emmoth, E., Albihn, A., Vinneras, B., and Ottoson, J. (2012). Composting for Avian Influenza Virus Elimination. Applied and Environmental Microbiology 78(9), 3280-3285.
Emanuelsson, F., Claesson, B.E.B., Ljungström, L., Tvede, M., and Ung, K.-A. (2014). Faecal microbiota transplantation and bacteriotherapy for recurrent Clostridium difficile infection: A retrospective evaluation of 31 patients. Scandinavian Journal of Infectious Diseases 46(2), 89-97.
Endt, K., Stecher, B., Chaffron, S., Slack, E., Tchitchek, N., Benecke, A., Van Maele, L., Sirard, J.-C., Mueller, A.J., Heikenwalder, M., et al. (2010). The Microbiota Mediates Pathogen Clearance from the Gut Lumen after Non-Typhoidal Salmonella Diarrhea. PLoS Pathog 6(9), e1001097.
European Extended Search Report, European Application No. 14768281.9, dated Jul. 18, 2016, 10 pages.
European Extended Search Report, European Application No. 14763266.5, dated Aug. 16, 2016, 7 pages.
Everard, A., Belzer, C., Geurts, L., Ouwerkerk, J.P., Druart, C., Bindels, L.B., Guiot, Y., Derrien, M., Muccioli, G.G., Delzenne, N.M., et al. (2013). Cross-talk between Akkermansia muciniphila and intestinal epithelium controls diet-induced obesity. Proceedings of the National Academy of Sciences 110(22), 9066-9071.
Fairhead, H., Setlow, B., Waites, W.M., and Setlow, P. (1994). Small, acid-soluble proteins bound to DNA protect Bacillus subtilis spores from being killed by freeze-drying. Applied and Environmental Microbiology 60(7), 2647-2649.
Faith, J.J., Ahern, P.P., Ridaura, V.K., Cheng, J., and Gordon, J.I. (2014). Identifying Gut Microbe—Host Phenotype Relationships Using Combinatorial Communities in Gnotobiotic Mice. Sci Transl Med 6(220), 220ra11-220ra11.
Fakhry, S., Sorrentini, I., Ricca, E., De Felice, M., and Baccigalupi, L. (2008). Characterization of spore forming Bacilli isolated from the human gastrointestinal tract. Journal of Applied Microbiology 105(6), 2178-2186.
Faust, et al., "Microbial Co-occurrence Relationships in the Human Microbiome," PLoS Computational Biology, Jul. 2012, e1002606, 17 pages, vol. 8, No. 7.
Fell Jr., N.F., Pellegrino, P.M., and Gillespie, J.B. (2001). Mitigating phosphate interference in bacterial endospore detection by Tb dipicolinate photoluminescence. Analytica Chimica Acta 426(1), 43-50.
Fichtel, J., Köster, J., Rullkötter, J., and Sass, H. (2007). Spore dipicolinic acid contents used for estimating the number of endospores in sediments. FEMS Microbiology Ecology 61(3), 522-532.
Fischbach, M.A., Bluestone, J.A., and Lim, W.A. (2013). Cell-Based Therapeutics: The Next Pillar of Medicine. Sci Transl Med 5(179), 179ps7.
Fonseca, F., Béal, C., and Corrieu, G. (2001). Operating Conditions That Affect the Resistance of Lactic Acid Bacteria to Freezing and Frozen Storage. Cryobiology 43(3), 189-198.

Franz, C.M.A.P., Huch, M., Abriouel, H., Holzapfel, W., and Gálvez, A. (2011). Enterococci as probiotics and their implications in food safety. International Journal of Food Microbiology 151(2), 125-140.
Friedman-Moraco, R.J., Mehta, A.K., Lyon, G.M., and Kraft, C.S. (2014). Fecal Microbiota Transplantation for Refractory Clostridium difficile Colitis in Solid Organ Transplant Recipients: Fecal Microbiota Transplantation in Solid Organ Transplant Recipients. American Journal of Transplantation 14(2), 477-480.
Fuentes, S., Van Nood, E., Tims, S., Heikamp-De Jong, I., Ter Braak, C.J., Keller, J.J., Zoetendal, E.G., and De Vos, W.M. (2014). Reset of a critically disturbed microbial ecosystem: faecal transplant in recurrent Clostridium difficile infection. The ISME Journal.
GenBank HQ819637, "Uncultured Organism Clone ELU0180-T56-S-NIPCRAMgANa_000311 Small Subunit Ribosomal RNA Gene, Partial Sequence," Jul. 30, 2012, 1 page, [Online] [Retrieved on Aug. 21, 2014] Retrieved from the Internet<URL:http://www.ncbi.nlm.nih.gov/nuccore/HQ819637>.
Gevers, D., Kugathasan, S., Denson, L.A., Vazquez-Baeza, Y., Van Treuren, W., Ren, B., Schwager, E., Knights, D., Song, S.J., Yassour, M., et al. (2014). The Treatment-Naive Microbiome in New-Onset Crohn's Disease. Cell Host & Microbe 15(3), 382-392.
Gilligan, P.H. (2013). Identification of Pathogens by Classical Clinical Tests. In the Prokaryotes, E. Rosenberg, E.F. DeLong, S. Lory, E. Stackebrandt, and F. Thompson, eds. (Springer Berlin Heidelberg), pp. 57-89.
Goodman, A.L., Kallstrom, G., Faith, J.J., Reyes, A., Moore, A., Dantas, G., and Gordon, J.I. (2011). From the Cover: Extensive personal human gut microbiota culture collections characterized and manipulated in gnotobiotic mice. Proceedings of the National Academy of Sciences 108(15), 6252-6257.
Goodman, N.S., Gottfried, R.J., and Rogoff, M.H. (1967). Biphasic system for separation of spores and crystals of Bacillus thuringiensis. Journal of Bacteriology 94(2), 485.
Gough, E. et al., "Systematic Review of Intestinal Microbiota Transplantation (Fecal Bacteriotherapy) for Recurrent Clostridium Dfficile Infection," Clin. Infect. Dis., Nov. 15, 2011, pp. 994-1002, vol. 53, No. 10.
Gould, G.W., and Sale, A.J. (1970). Initiation of germination of bacterial spores by hydrostatic pressure. J. Gen. Microbiol. 60(3), 335-346.
Grabow, W.O., Clay, C.G., Dhaliwal, W., Vrey, M.A., and Müller, E.E. (1999). Elimination of viruses, phages, bacteria and Cryptosporidium by a new generation Aquaguard point-of-use water treatment unit. Zentralbl Hyg Umweltmed 202(5), 399-410.
Greenway, F., Wang, S., and Heiman, M. (2014). A novel cobiotic containing a prebiotic and an antioxidant augments the glucose control and gastrointestinal tolerability of metformin: a case report. Beneficial Microbes 5(1), 29-32.
Grehan, M.J., Borody, T.J., Leis, S.M., Campbell, J., Mitchell, H., and Wettstein, A. (2010). Durable alteration of the colonic microbiota by the administration of donor fecal flora. J. Clin. Gastroenterol. 44(8), 551-561.
Grimoud, J. et al., "In Vitro Screening of Probiotic Lactic Acid Bacteria and Prebiotic Glucooligosaccharides to Select Effective Synbiotics," Anaerobe, Clinical Microbiology, Oct. 2010, pp. 493-500, vol. 16, No. 5.
Gupta, R.K. et al., "Differentiation Between Heat Resistance and Octyl Alcohol Resistance of the Cells of Bacillus Cereus T.," Biochemical and Biophysical Research Communications, 1970, pp. 23-30, vol. 38, No. 1.
Halmann, M. et al., "Stages in Germination of Spores of Bacillus Lichenformis," J. Bacteriol., 1962, pp. 1187-1193, vol. 84.
Hamilton, M.J., Weingarden, A.R., Sadowsky, M.J., and Khoruts, A. (2012). Standardized frozen preparation for transplantation of fecal microbiota for recurrent Clostridium difficile infection. Am. J. Gastroenterol. 107(5), 761-767.
Hamilton, M.J., Weingarden, A.R., Unno, T., Khoruts, A., and Sadowsky, M.J. (2013). High-throughput DNA sequence analysis reveals stable engraftment of gut microbiota following transplantation of previously frozen fecal bacteria. Gut Microbes 4(2), 125-135.

(56) References Cited

OTHER PUBLICATIONS

Harmsen, H. J. M., Gibson, G. R., Elfferich, P., Raangs, G. C., Wildeboer-Veloo, A. C. M., Argaiz, A., Roberfroid, M. B., and Welling, G. W. (2000). Comparison of viable cell counts and fluorescence in situ hybridization using specific rRNA-based probes for the quantification of human fecal bacteria. FEMS Microbiology Letters 183(1), 125-129.

Harrison, F., "Bacterial Cooperation in the Wild and in the Clinic: Are Pathogen Social Behaviours Relevant Outside the Laboratory?" Bioessays, Dec. 27, 2012, pp. 108-112, vol. 35, No. 2.

Hasan, J.A., Japal, K.M., Christensen, E.R., and Samalot-Freire, L.C. (2011). In vitro production of Clostridium difficile spores for use in the efficacy evaluation of disinfectants: a precollaborative investigation. J AOAC Int 94(1), 259-272.

Hayashi, Y. et al., "Western Blot (Immunoblot) Assay of Small Round-Structured Virus Associated with an Acute Gastroenteritis Outbreak in Tokyo," Journal of Clinical Microbiology, Aug. 1989, pp. 1728-1733, vol. 27.

Hell, M., Bernhofer, C., Stalzer, P., Kern, J.M., and Claassen, E. (2013). Probiotics in Clostridium difficile infection: reviewing the need for a multistrain probiotic. Beneficial Microbes 4(1), 39-51.

Hemmerling, A., Harrison, W., Schroeder, A., Park, J., Korn, A., Shiboski, S., Foster-Rosales, A., and Cohen, C.R. (2010). Phase 2a Study Assessing Colonization Efficiency, Safety, and Acceptability of Lactobacillus crispatus CTV-05 in Women With Bacterial Vaginosis: Sexually Transmitted Diseases 37(12), 745-750.

Herron, P.R., and Wellington, E.M.H. (1990). New Method for Extraction of Streptomycete Spores from Soil and Application to the Study of Lysogeny in Sterile Amended and Nonsterile Soil. Appl Environ Microbiol 56(5), 1406-1412.

Hewitt, J., Rivera-Aban, M., and Greening, G.E. (2009). Evaluation of murine norovirus as a surrogate for human norovirus and hepatitis A virus in heat inactivation studies. Journal of Applied Microbiology 107(1), 65-71.

Hindle, A.A., and Hall, E.A.H. (1999). Dipicolinic acid (DPA) assay revisited and appraised for spore detection. The Analyst 124(11), 1599-1604.

Hirsch, E.B., and Tam, V.H. (2010). Detection and treatment options for Klebsiella pneumoniae carbapenemases (KPCs): an emerging cause of multidrug-resistant infection. J. Antimicrob. Chemother. 65(6), 1119-1125.

Hofsten, B.V. (1966). Partition of *Escherichia coli* in an aqueous polymer two-phase system. Experimental Cell Research 41(1), 117-123.

Holmes, E., Kinross, J., Gibson, G.R., Burcelin, R., Jia, W., Pettersson, S., and Nicholson, J.K. (2012). Therapeutic Modulation of Microbiota-Host Metabolic Interactions. Science Translational Medicine 4(137), 137rv6-137rv6.

Hoppe, B., Groothoff, J.W., Hulton, S.-A., Cochat, P., Niaudet, P., Kemper, M.J., Deschênes, G., Unwin, R., and Milliner, D. (2011). Efficacy and safety of Oxalobacter formigenes to reduce urinary oxalate in primary hyperoxaluria. Nephrol. Dial. Transplant. 26(11), 3609-3615.

Hoyles, L., Honda, H., Logan, N.A., Halket, G., La Ragione, R.M., and McCartney, A.L. (2012). Recognition of greater diversity of Bacillus species and related bacteria in human faeces. Res. Microbiol. 163(1), 3-13.

Hurst, C.J., and Gerba, C.P. (1989). Fate of viruses during wastewater sludge treatment processes. Critical Reviews in Environmental Control 18(4), 317-343.

Iizuka, M. et al., "Elemental Diet Modulates the Growth of Clostridium difficile in the Gut Flora," Aliment Pharmacol. Ther., Jul. 2004, pp. 151-157, vol. 20, Suppl. 1.

Itoh, K., and Mitsuoka, T. (1985). Characterization of clostridia isolated from faeces of limited flora mice and their effect on caecal size when associated with germ-free mice. Laboratory Animals 19(2), 111-118.

Itoh, K., Lee, W.K., Kawamura, H., Mitsuoka, T., and Magaribuchi, T. (1987). Intestinal bacteria antagonistic to Clostridium difficile in mice. Lab Anim 21(1), 20-25.

Itoh, K., Urano, T., and Mitsuoka, T. (1986). Colonization resistance against Pseudomonas aeruginosa in gnotobiotic mice. Lab Anim 20(3), 197-201.

Jalanka-Tuovinen, J., Salojarvi, J., Salonen, A., Immonen, O., Garsed, K., Kelly, F.M., Zaitoun, A., Palva, A., Spiller, R.C., and De Vos, W.M. (2013). Faecal microbiota composition and host-microbe cross-talk following gastroenteritis and in postinfectious irritable bowel syndrome. Gut 0, 1-9.

Jeffs, L.B., and Khachatourians, G.G. (1997). Estimation of spore hydrophobicity for members of the genera *Beauveria, Metarhizium,* and *Tolypocladium* by salt-mediated aggregation and sedimentation. Canadian Journal of Microbiology 43(1), 23-28.

Jensen, N.S., and Canale-Parola, E. (1986). *Bacteroides pectinophilus* sp. nov. and *Bacteroides galacturonicus* sp. nov.: two pectinolytic bacteria from the human intestinal tract. Appl. Environ. Microbiol. 52(4), 880-887.

Johnston, R. et al., "Method to Facilitate the Isolation of Clostridium botulinum Type E," J. Bacteriol., 1964, pp. 1521-1522, vol. 88.

Jones, M.L., Martoni, C.J., and Prakash, S. (2012a). Cholesterol lowering and inhibition of sterol absorption by Lactobacillus reuteri NCIMB 30242: a randomized controlled trial. Eur J Clin Nutr 66(11), 1234-1241.

Jones, M.L., Martoni, C.J., Parent, M., and Prakash, S. (2012b). Cholesterol-lowering efficacy of a microencapsulated bile salt hydrolase-active Lactobacillus reuteri NCIMB 30242 yoghurt formulation in hypercholesterolaemic adults. British Journal of Nutrition 107(10), 1505-1513.

Joosten, H. et al., "Salmonelle Detection in Probiotic Products," International Journal of Food Microbiology, Jul. 2006, pp. 104-107, vol. 110, No. 1.

Jorgensen, J.H., and Ferraro, M.J. (2009). Antimicrobial Susceptibility Testing: A Review of General Principles and Contemporary Practices. Clin Infect Dis., Medical Microbiology, 49(11), 1749-1755.

Jorup-Rönström, C., Håkanson, A., Sandell, S., Edvinsson, O., Midtvedt, T., Persson, A.-K., and Norin, E. (2012). Fecal transplant against relapsing Clostridium difficile-associated diarrhea in 32 patients. Scand. J. Gastroenterol. 47(5), 548-552.

Jousimies-Somer, H., Summanen, P., Citron, D.M., Baron, E.J., Wexler, H.M., and Finegold, S.M. (2002). Wadsworth-KLT Anaerobic Bacteriology Manual, 6th edition (California: Star), pp. 55-74, 81-132, 165-185.

Kailasapathy, K. (2002). Microencapsulation of probiotic bacteria: technology and potential applications. Curr Issues Intest Microbiol 3(2), 39-48.

Kamiya, S., Yamakawa, K., Ogura, H., and Nakamura, S. (1989). Recovery of spores of Clostridium difficile altered by heat or alkali. J Med Microbiol 28(3), 217-221.

Kanamoto, T. et al., "Genetic Heterogeneities and Phenotypic Characteristics of Strains of the Genus *Abiotrophia* and Proposal of *Abiotrophia para-adiacens* sp. nov.," Journal of Clinical Microbiology, Feb. 2000, pp. 492-498, vol. 38, No. 2; Abiotropia para-adjacens gene for 16S rRNA, partial sequence, strain: Nucleotide: NCBI: GenBank: AB022027.1, last accessed Mar. 12, 2014, p. 8.

Kanehisa Laboratories. KEGG: Kyoto encyclopedia of genes and genomes <http://www.genome.jp/kegg/> Accessed Mar. 27, 2014.

Karasawa, T. et al., "A Defined Growth Medium for Clostridium difficile," Microbiology, Feb. 1995, pp. 371-375, vol. 151, No. 2.

Kazamias, M. et al., "Enhanced Fermentation of Mannitol and Release of Cytotoxin by Clostridium difficile in Alkaline Culture Media," Applied and Environmental Microbiology, Jun. 1995, pp. 2425-2427, vol. 61, No. 6.

Kelly, D., Campbell, J.I., King, T.P., Grant, G., Jansson, E.A., Coutts, A.G.P., Pettersson, S., and Conway, S. (2003). Commensal anaerobic gut bacteria attenuate inflammation by regulating nuclear-cytoplasmic shuttling of PPAR-γ and RelA. Nature Immunology 5(1), 104-112.

Khoruts, A. (2013). How Does Fecal Microbiota Transplantation Treat Clostridium difficile Infection? <https://www.genome.gov/Multimedia/Slides/HumanMicrobiomeScience2013/39_Khoruts.pdf> Accessed Mar. 21, 2014.

Khoruts, A., and Sadowsky, M.J. (2011). Therapeutic transplantation of the distal gut microbiota. Mucosal Immunol 4(1), 4-7.

(56) References Cited

OTHER PUBLICATIONS

Khoruts, A., Dicksved, J., Jansson, J.K., and Sadowsky, M.J. (2010). Changes in the composition of the human fecal microbiome after bacteriotherapy for recurrent Clostridium difficile-associated diarrhea. J. Clin. Gastroenterol. 44(5), 354-360.

Kim, B., Kim, N.J., Kim, M., Kim, Y.S., Woo, J., and Ryu, J. (2003). Bacteraemia Due to Tribe Proteeae: A Review of 132 Cases During a Decade (1991-2000). Scandinavian Journal of Infectious Diseases 35(2), 98-103.

Klayraung, S., Viernstein, H., and Okonogi, S. (2009). Development of tablets containing probiotics: Effects of formulation and processing parameters on bacterial viability. International Journal of Pharmaceutics 370(1-2), 54-60.

Kollmann, M. et al., Design Principles of a Bacterial Signalling Network, Nature, Nov. 24, 2005, pp. 504-507, vol. 438, No. 7067.

Kong, Q., He, G.-Q., Jia, J.-L., Zhu, Q.-L., and Ruan, H. (2011). Oral Administration of Clostridium butyricum for Modulating Gastrointestinal Microflora in Mice. Curr Microbiol 62(2), 512-517.

Konstantinidis, K.T., Ramette, A., and Tiedje, J.M. (2006). The bacterial species definition in the genomic era. Philos Trans R Soc Lond B Biol Sci 361(1475), 1929-1940.

Koonin, E.V. (2002). Chapter 22 The clusters of orthologous groups (COGS) database: Phylogenetic classification of proteins from complete genomes. <http://www.ncbi.nlm.nih.gov/books/NBK21090/pdf/ch22.pdf> Accessed Mar. 27, 2014.

Koransky, J.R., Allen, S.D., and Dowell, V.R., Jr (1978). Use of ethanol for selective isolation of sporeforming microorganisms. Appl. Environ. Microbiol. 35(4), 762-765.

Koransky, J.R. et al., "Use of Ethanol for Selective Isolation of Sporeforming Microorganisms," Applied and Environmental Microbiology, Apr. 1978, pp. 762-765, vol. 35.

Kort, R., O'Brien, A.C., Stokkum, I.H.M. Van, Oomes, S.J.C.M., Crielaard, W., Hellingwerf, K.J., and Brul, S. (2005). Assessment of Heat Resistance of Bacterial Spores from Food Product Isolates by Fluorescence Monitoring of Dipicolinic Acid Release. Appl. Environ. Microbiol. 71(7), 3556-3564.

Kucerova, Z., Moura, H., Leitch, G.J., Sriram, R., Bern, C., Kawai, V., Vargas, D., Gilman, R.H., Ticona, E., and Vivar, A. (2004). Purification of Enterocytozoon bieneusi spores from stool specimens by gradient and cell sorting techniques. Journal of Clinical Microbiology 42(7), 3256-3261.

Kumar, M. et al., "Cholesterol-Lowering Probiotics as Potential Biotherapeutics for Metabolic Diseases," Experimental Diabetes Research, 2012, Article ID 902917, 14 pages, vol. 2012.

Kump, P.K., Gröchenig, H.-P., Lackner, S., Trajanoski, S., Reicht, G., Hoffmann, K.M., Deutschmann, A., Wenzl, H.H., Petritsch, W., Krejs, G.J., et al. (2013). Alteration of intestinal dysbiosis by fecal microbiota transplantation does not induce remission in patients with chronic active ulcerative colitis. Inflamm. Bowel Dis. 19(10), 2155-2165.

Kunde, S., Pham, A., Bonczyk, S., Crumb, T., Duba, M., Conrad, H., Jr, Cloney, D., and Kugathasan, S. (2013). Safety, tolerability, and clinical response after fecal transplantation in children and young adults with ulcerative colitis. J. Pediatr. Gastroenterol. Nutr. 56(6), 597-601.

Landy, J., Al-Hassi, H.O., Mclaughlin, S.D., Walker, A.W., Ciclitira, P.J., Nicholls, R.J., Clark, S.K., and Hart, A.L. (2011). Review article: faecal transplantation therapy for gastrointestinal disease. Alimentary Pharmacology & Therapeutics 34(4), 409-415.

Lawley, T.D., Clare, S., Walker, A.W., Stares, M.D., Connor, T.R., Raisen, C., Goulding, D., Rad, R., Schreiber, F., Brandt, C., et al. (2012). Targeted Restoration of the Intestinal Microbiota with a Simple, Defined Bacteriotherapy Resolves Relapsing Clostridium difficile Disease in Mice. PLoS Pathog 8(10), e1002995.

Lawson, P.A., Song, Y., Liu, C., Molitoris, D.R., Vaisanen, M.-L., Collins, M.D., and Finegold, S.M. (2004). *Anaerotruncus colihominis* gen. nov., sp. nov., from human faeces. Int J Syst Evol Microbiol 54(2), 413-417.

Lee, I.-K., and Liu, J.-W. (2006). Clinical characteristics and risk factors for mortality in Morganella morganii bacteremia. J Microbiol Immunol Infect 39(4), 328-334.

Lee, J.S., Cha, D.S., and Park, H.J. (2004). Survival of Freeze-Dried Lactobacillus bulgaricus KFRI 673 in Chitosan-Coated Calcium Alginate Microparticles. J. Agric. Food Chem. 52(24), 7300-7305.

Lee, M., Hesek, D., Shah, I.M., Oliver, A.G., Dworkin, J., and Mobashery, S. (2010). Synthetic peptidoglycan motifs for germination of bacterial spores. Chembiochem 11(18), 2525-2529.

Lehar, J. (2007). Chemical combination effects predict connectivity in biological systems, Molecular Systems Biology, pp. 1-14, vol. 3, Article No. 80.

Lemon, K.P., Armitage, G.C., Relman, D.A., and Fischbach, M.A. (2012). Microbiota-Targeted Therapies: An Ecological Perspective. Science Translational Medicine 4(137), 137rv5-137rv5.

Leslie, S.B., Israeli, E., Lighthart, B., Crowe, J.H., and Crowe, L.M. (1995). Trehalose and sucrose protect both membranes and proteins in intact bacteria during drying. Applied and Environmental Microbiology 61(10), 3592-3597.

Liggins, M., Ramirez, N., Magnuson, N., and Abel-Santos, E. (2011). Progesterone analogs influence germination of Clostridium sordellii and Clostridium difficile spores in vitro. J. Bacteriol. 193(11), 2776-2783.

Lindsay, J.A., Beaman, T.C., and Gerhardt, P. (1985). Protoplast water content of bacterial spores determined by buoyant density sedimentation. J. Bacteriol. 163(2), 735-737.

Liu, K., Linder, C.R., and Warnow, T. (2011). RAxML and FastTree: Comparing Two Methods for Large-Scale Maximum Likelihood Phylogeny Estimation. PLoS One 6(11), e27731.

Livingston, S.J., Kominos, S.D., and Yee, R.B. (1978). New medium for selection and presumptive identification of the Bacteroides fragilis group. J. Clin. Microbiol. 7(5), 448-453.

Logan, N.A., "Bacillus and Relatives in Foodborne Illness," Journal of Applied Microbiology, Mar. 20, 2012, pp. 417-429, vol. 112, No. 3.

Lopetuso, L.R., Scaldaferri, F., Petito, V., and Gasbarrini, A. (2013). Commensal Clostridia: leading players in the maintenance of gut homeostasis. Gut Pathogens 5(1), 23.

Lodish, H. et al., "Viruses: Structure, Function, and Uses," Molecular Cell Biology, $4^{th}$ Edition, 2000, pp. 1-12.

Lozupone, C., Faust, K., Raes, J., Faith, J.J., Frank, D.N., Zaneveld, J., Gordon, J.I., and Knight, R. (2012). Identifying genomic and metabolic features that can underlie early successional and opportunistic lifestyles of human gut symbionts. Genome Res 22(10), 1974-1984.

Malik, K.A. (1988). A new freeze-drying method for the preservation of nitrogen-fixing and other fragile bacteria. Journal of Microbiological Methods 8(5), 259-271.

Manichanh, C. (2006). Reduced diversity of faecal microbiota in Crohn's disease revealed by a metagenomic approach. Gut 55(2), 205-211.

Matsuda, K. et al., "Sensitive Quantitative Detection of Commensal Bacteria by rRNA-Targeted Reverse Transcription-PCR," Applied and Environmental Microbiology, Jan. 2007, pp. 32-39, vol. 73, No. 1.

Mbithi, J.N., Springthorpe, V.S., and Sattar, S.A. (1990). Chemical disinfection of hepatitis A virus on environmental surfaces. Applied and Environmental Microbiology 56(11), 3601-3604.

McFarland, L.V., "Use of Probiotics to Correct Dysbiosis of Normal Microbiota Following Disease or Disruptive Events: A Systematic Review," BMJ Open, 2014, pp. 1-18, vol. 4.

McGuire, G., Denham, M.C., and Balding, D.J. (2001). Models of Sequence Evolution for DNA Sequences Containing Gaps. Mol Biol Evol 18(4), 481-490.

McNulty, N.P., Yatsunenko, T., Hsiao, A., Faith, J.J., Muegge, B.D., Goodman, A.L., Henrissat, B., Oozeer, R., Cools-Portier, S., Gobert, G., et al. (2011). The impact of a consortium of fermented milk strains on the gut microbiome of gnotobiotic mice and monozygotic twins. Sci Transl Med 3(106), 106ra106.

Mevissen-Verhage, E.A., Marcelis, J.H., Vos, M.N. De, Amerongen, W.C.H., and Verhoef, J. (1987). *Bifidobacterium, Bacteroides,* and

(56) References Cited

OTHER PUBLICATIONS

*Clostridium* spp. in fecal samples from breast-fed and bottle-fed infants with and without iron supplement. J. Clin. Microbiol. 25(2), 285-289.
Miller, R.S., and Hoskins, L.C. (1981). Mucin degradation in human colon ecosystems. Fecal population densities of mucin-degrading bacteria estimated by a "most probable number" method. Gastroenterology 81(4), 759-765.
Mireau, I. et al., "Industrial-Scale Production and Purification of a Heterologous Protein in Lactococcus Lactis Using the Nisin-Controlled Gene Expression System NICE: The Case of Lysostaphin," Microbial Cell Factories, May 27, 2005, pp. 1-9, vol. 4, No. 15.
Miyamoto-Shinohara, Y., Sukenobe, J., Imaizumi, T., Nakahara, T., and Others (2008). Survival of freeze-dried bacteria. The Journal of General and Applied Microbiology 54(1), 9.
Momose, Y. et al., "165 rRNA Gene Sequence-Based Analysis of Clostridia Related to Conversion of Germfree Mice to the Normal State," Journal of Applied Microbiology, 2009, pp. 2088-2097, vol. 107.
Morgan, C.A., Herman, N., White, P.A., and Vesey, G. (2006). Preservation of micro-organisms by drying; A review. Journal of Microbiological Methods 66(2), 183-193.
Murri, M., Leiva, I., Gomez-Zumaquero, J.M., Tinahones, F.J., Cardona, F., Soriguer, F., and Queipo-Ortuño, M.I. (2013). Gut microbiota in children with type 1 diabetes differs from that in healthy children: a case-control study. BMC Med 11(1), 1-12.
Myllyluoma, E. et al., "Effects of Multispecies Probiotic Combination on Helicobacter pylori Infection in Vitro," Clinical and Vaccine Immunology, Sep. 2008, pp. 1472-1482, vol. 15, No. 9.
Naaber P et al "Inhibition of Clostridium difficile strains by intestinal Lactobacillus species" Journal of Medical Microbiology, 2004, pp. 551-554, vol. 53.
New Zealand First Examination Report, New Zealand Application No. 709392, dated Oct. 5, 2015, 7 pages.
New Zealand First Examination Report, New Zealand Application No. 711771, dated Nov. 23, 2015, 6 pages.
New Zealand First Examination Report, New Zealand Application No. 711773, dated Nov. 24, 2015, 6 pages.
New Zealand Second Examination Report, New Zealand Application No. 709392, dated Jun. 9, 2016, 7 pages.
Nicholson, W.L., and Law, J.F. (1999). Method for purification of bacterial endospores from soils: UV resistance of natural Sonoran desert soil populations of< i>*Bacillus*</i> spp. with reference to< i> B. subtilis</i> strain 168. Journal of Microbiological Methods 35(1), 13-21.
NIH human microbiome project. <http://www.hmpdacc.org/> Accessed Mar. 27, 2014.
Nishio, J., Atarashi, K., Tanoue, T., Baba, M., Negishi, H., Yanai, H., Honda, K., Benoist, C., Mathis, D., and Taniguchi, T. (2013). Impact of TCR repetoire on intestinal homeostasis (Taos, NM).
Nitert, M.D., Barrett, H.L., Foxcroft, K., Tremellen, A., Wilkinson, S., Lingwood, B., Tobin, J.M., McSweeney, C., O'Rourke, P., McIntyre, H.D., et al. (2013). Spring: an RCT study of probiotics in the prevention of gestational diabetes mellitus in overweight and obese women. BMC Pregnancy and Childbirth 13(1), 50.
Noack, J., Kleessen, B., Proll, J., Dongowski, G., and Blaut, M. (1998). Dietary guar gum and pectin stimulate intestinal microbial polyamine synthesis in rats. J. Nutr. 128(8), 1385-1391.
Nyangale, et al., "Gut Microbial Activity, Implications for Health and Disease: the Potential Role of Metabolite Analysis," J. Proteome Res., 2012, pp. 5573-5585. vol. 11, No. 12.
O'Hara, C.M., Brenner, F.W., and Miller, J.M. (2000). Classification, identification, and clinical significance of Proteus, Providencia, and Morganella. Clin. Microbiol. Rev. 13(4), 534-546.
Okada, Y., Setoyama, H., Matsumoto, S., Imaoka, A., Nanno, M., Kawaguchi, M., and Umesaki, Y. (1994). Effects of fecal microorganisms and their chloroform-resistant variants derived from mice, rats, and humans on immunological and physiological characteristics of the intestines of ex-germfree mice. Infect. Immun. 62(12), 5442-5446.

Olle, B. (2013). Medicines from microbiota. Nat. Biotechnol. 31(4), 309-315.
Openbiome. Quality metrics. <http://static.squarespace.com/static/50e0c29ae4b0a05702af7e6a/t/52e19689e4b0b28f802c9b4e/1390517129976/OpenBiome%20Quality%20Metrics.pdf> Accessed Mar. 21, 2014.
Owens, C., Broussard, E., and Surawicz, C. (2013). Fecal microbiota transplantation and donor standardization. Trends in Microbiology 21(9), 443-445.
Paine, R.T. (1969). A note on trophic complexity and community stability. American Naturalist 103(929), 91-93.
Palmfeldt, J., and Hahn-Hägerdal, B. (2000). Influence of culture pH on survival of< i> Lactobacillus reuteri</i> subjected to freeze-drying. International Journal of Food Microbiology 55(1), 235-238.
Pamer, E.G. (2014). Fecal microbiota transplantation: effectiveness, complexities, and lingering concerns. Mucosal Immunology 7(2), 210-214.
Paredes-Sabja, D., Udompijitkul, P., and Sarker, M.R. (2009). Inorganic phosphate and sodium ions are cogerminants for spores of Clostridium perfringens type A food poisoning-related isolates. Appl. Environ. Microbiol. 75(19), 6299-6305.
Path Vaccine and Pharmaceutical Technologies Group. Summary of stability data for investigational formulations of vaccines. <http://www.path.org/publications/files/TS_vaccine_stability_table_invest.pdf> Accessed Mar. 21, 2014.
PCT International Search Report and Written Opinion, PCT Application No. PCT/US14/14744, dated May 21, 2014, 36 pages.
PCT International Search Report and Written Opinion, PCT Application No. PCT/US14/14747, dated Jun. 13, 2014, 27 pages.
PCT International Search Report and Written Opinion, PCT Application No. PCT/US14/14738, dated Jul. 30, 2014, 32 pages.
PCT International Search Report and Written Opinion, PCT Application No. PCT/US14/14745, dated Jul. 30, 2014, 31 pages.
PCT Invitation to Pay Additional Fees, PCT Application No. PCT/US14/14745, dated May 16, 2014, 2 pages.
PCT International Search Report and Written Opinion, PCT Application No. PCT/US13/71758, dated May 5, 2014, 45 pages.
PCT Invitation to Pay Additional Fees, PCT Application No. PCT/US14/70684, dated Mar. 24, 2015, 2 pages.
PCT International Search Report and Written Opinon, PCT Application No. PCT/US2014/067491, dated Apr. 2, 2015, 14 pages.
PCT International Search Report and Written Opinion, PCT Application No. PCT/US14/70684, dated Jun. 10, 2015, 24 pages.
PCT Invitation to Pay Additional Fees, PCT Application No. PCT/US13/71758, dated Feb. 25, 2014, 4 pages.
PCT Invitation to Pay Additional Fees, PCT Application No. PCT/US2014/014738, dated May 16, 2014, 2 pages.
PCT International Search Report and Written Opinion, PCT Application No. PCT/US2014/030817, dated Dec. 5, 2014, 16 pages.
PCT Invitation to Pay Additional Fees, PCT Application No. PCT/US2014/030817, dated Sep. 8, 2014, 5 pages.
PCT International Search Report and Written Opinion, PCT Application No. PCT/US2014/029539, dated Oct. 10, 2014, 17 pages.
PCT Invitation to Pay Additional Fees, PCT Application No. PCT/US14/29539, dated Jul. 31, 2014, 3 pages.
Peck, M.W. et al., "Development and Application of a New Method for Specific and Sensitive Enumeration of Spores of Nonproteolytic Clostridium Botulinum Types B, E and F in Foods and Food Materials," Applied and Environmental Microbiology, Oct. 2010, pp. 6607-6614, vol. 76, No. 19.
Pehkonen, K.S., Roos, Y.H., Miao, S., Ross, R.P., and Stanton, C. (2008). State transitions and physicochemical aspects of cryoprotection and stabilization in freeze-drying of Lactobacillus rhamnosus GG (LGG). Journal of Applied Microbiology 104(6), 1732-1743.
Peighambardoust, S.H., Golshan Tafti, A., and Hesari, J. (2011). Application of spray drying for preservation of lactic acid starter cultures: a review. Trends in Food Science & Technology 22(5), 215-224.
Pellegrino, P.M., Fell Jr., N.F., and Gillespie, J.B. (2002). Enhanced spore detection using dipicolinate extraction techniques. Analytica Chimica Acta 455(2), 167-177.
Perez, F., Pultz, M.J., Endimiani, A., Bonomo, R.A., and Donskey, C.J. (2011). Effect of antibiotic treatment on establishment and

(56) References Cited

OTHER PUBLICATIONS elimination of intestinal colonization by KPC-producing Klebsiella pneumoniae in mice. Antimicrob. Agents Chemother. 55(6), 2585-2589.
Perez, J., Springthorpe, V.S., and Sattar, S.A. (2011). Clospore: a liquid medium for producing high titers of semi-purified spores of Clostridium difficile. J AOAC Int 94(2), 618-626.
Peterson, D.A. et al., "Metagenomic Approaches for Defining the Pathogenesis of Inflammatory Bowel Diseases," Cell Host Microbe, Jun. 2008, pp. 417-427, vol. 3, No. 6.
Petrof, E.O., Claud, E.C., Gloor, G.B., and Allen-Vercoe, E. (2013a). Microbial ecosystems therapeutics: a new paradigm in medicine? Beneficial Microbes 4(1), 53-65.
Petrof, E.O., Gloor, G.B., Vanner, S.J., Weese, S.J., Carter, D., Daigneault, M.C., Brown, E.M., Schroeter, K., and Allen-Vercoe, E. (2013b). Stool substitute transplant therapy for the eradication of Clostridium difficile infection: "RePOOPulating" the gut, Microbiome, Jan. 9, 2013, p. 3, vol. 1, No. 1.
Petrof, E.O. et al., "Stool Substitute Transplant Therapy for the Eradication of Clostridium difficile Infection: RePOOPulating" The Gut Microbiome, Jan. 9, 2013, pp. 1-12, vol. 1, No. 3.
Picot, A., and Lacroix, C. (2004). Encapsulation of bifidobacteria in whey protein-based microcapsules and survival in simulated gastrointestinal conditions and in yoghurt. International Dairy Journal 14(6), 505-515.
Pinn, D. et al. (2013). Follow-up Study of Fecal Microbiota Transplantation (FMT) for the Treatment of Refractory Irritable Bowel Syndrome (IBS). Abstract ACG 2013.
Postgate, J.R., and Hunter, J.R. (1961). On the Survival of Frozen Bacteria. J Gen Microbiol 26(3), 367-378.
"Potentials of Probiotics in Pig Nutrition," AllAboutFeed News, Jan. 31, 2007, 6 pages.
Prilassnig, M. et al., "Are Probiotics Detectable in Human Feces After Oral Uptake by Healthy Volunteers?" The Middle European Journal of Medicine, Aug. 2007, pp. 456-462, vol. 119, Nos. 15-16.
Pultz, N.J., Hoyen, C.K., and Donskey, C.J. (2004). Inhibition of methicillin-resistant *Staphylococcus aureus* by an in vitro continuous-flow culture containing human stool microflora. FEMS Microbiology Letters 241(2), 201-205.
Queenan, A.M., and Bush, K. (2007). Carbapenemases: the Versatile β-Lactamases. Clin. Microbiol. Rev. 20(3), 440-458.
Quigley, E.M.M. et al., "Small Intestinal Bacterial Overgrowth: Roles of Antibiotics, Prebiotics and Probiotics," Gastroenterology, Feb. 2006, pp. 78-90, vol. 130.
Raibaud, P., Ducluzeau, R., Dubos, F., Hudault, S., Bewa, H., and Muller, M.C. (1980). Implantation of bacteria from the digestive tract of man and various animals into gnotobiotic mice. Am J Clin Nutr 33(11), 2440-2447.
Ramirez, N., and Abel-Santos, E. (2010). Requirements for germination of Clostridium sordellii spores in vitro. J. Bacteriol. 192(2), 418-425.
Rao, A.V., Shiwnarain, N., and Maharaj, I. (1989). Survival of Microencapsulated Bifidobacterium pseudolongum in Simulated Gastric and Intestinal Juices. Canadian Institute of Food Science and Technology Journal 22(4), 345-349.
Reeves, A.E., Koenigsknecht, M.J., Bergin, I.L., and Young, V.B. (2012). Suppression of Clostridium difficile in the Gastrointestinal Tracts of Germfree Mice Inoculated with a Murine Isolate from the Family Lachnospiraceae. Infection and Immunity 80(11), 3786-3794.
Rexroad, J., Wiethoff, C.M., Jones, L.S., and Middaugh, C.R. (2002). Lyophilization and the thermostability of vaccines. Cell Preservation Technology 1(2), 91-104.
Ridaura, V.K., Faith, J.J., Rey, F.E., Cheng, J., Duncan, A.E., Kau, A.L., Griffin, N.W., Lombard, V., Henrissat, B., Bain, J.R., et al. (2013). Gut Microbiota from Twins Discordant for Obesity Modulate Metabolism in Mice. Science 341(6150), 1241214-1241214.
Robinson, I.M. et al., "Emendation of Acetivibrio and Description of Acetivibrio ethanolgignens, a New Species from the Colons of Pigs with Dysentery," International Journal of Systematic Bacteriology, Jul. 1981, pp. 333-338, vol. 31, No. 3.
Rode, L.J., and Foster, J.W. (1961). Germination of bacterial spores with alkyl primary amines1. J Bacteriol 81(5), 768-779.
Roffe, C. (1996). Biotherapy for antibiotic-associated and other diarrhoeas. J. Infect. 32(1), 1-10.
Rohlke, F., Surawicz, C.M., and Stollman, N. (2010). Fecal flora reconstitution for recurrent Clostridium difficile infection: results and methodology. J. Clin. Gastroenterol. 44(8), 567-570.
Rosen, D.L., Sharpless, C., and McGown, L.B. (1997). Bacterial Spore Detection and Determination by Use of Terbium Dipicolinate Photoluminescence. Anal. Chem. 69(6), 1082-1085.
Russell, A.D., "The Destruction of Bacterial Spores," 1982, pp. 191-193.
Russian Office Action, Russian Application No. 2015137399, dated Mar. 22, 2016, 8 pages.
Sack, D.A., Shimko, J., Sack, R.B., Gomes, J.G., Macleod, K., O'Sullivan, D., and Spriggs, D. (1997). Comparison of alternative buffers for use with a new live oral cholera vaccine, Peru-15, in outpatient volunteers. Infect. Immun. 65(6), 2107-2111.
Sacks, L.E., and Alderton, G. (1961). Behavior of bacterial spores in aqueous polymer two-phase systems. J. Bacteriol. 82, 331-341.
Sahlström, L., Bagge, E., Emmoth, E., Holmqvist, A., Danielsson-Tham, M.-L., and Albihn, A. (2008). A laboratory study of survival of selected microorganisms after heat treatment of biowaste used in biogas plants. Bioresour. Technol. 99(16), 7859-7865.
Santivarangkna, C., Kulozik, U., and Foerst, P. (2007). Alternative Drying Processes for the Industrial Preservation of Lactic Acid Starter Cultures. Biotechnology Progress 23(2), 302-315.
Sattar, S.A., Jason, T., Bidawid, S., and Farber, J. (2000). Foodborne spread of hepatitis A: recent studies on virus survival, transfer and inactivation. The Canadian Journal of Infectious Diseases 11(3), 159.
Savaiano, D.A., Ritter, A.J., Klaenhammer, T., Walker, M.R., Carlson, H.L.F., and Ruckle, J. (2012). A Novel High Purity Short-Chain Galacto-Oligosaccharide (RP-G28) Improves Lactose Digestion and Symptoms of Lactose Intolerance. Gastroenterology 142(5), S-182.
Savaiano, D.A., Ritter, A.J., Klaenhammer, T.R., Walker, W.A., James, G.M., Longcore, A.T., Chandler, J.R., and Foyt, H.L. (2013). Improving lactose digestion and symptoms of lactose intolerance with a novel galacto-oligosaccharide (RP-G28): a randomized, double-blind clinical trial. Nutrition Journal 12(1), 160.
Seale, R.B., Flint, S.H., McQuillan, A.J., and Bremer, P.J. (2008). Recovery of Spores from Thermophilic Dairy Bacilli and Effects of Their Surface Characteristics on Attachment to Different Surfaces. Appl Environ Microbiol 74(3), 731-737.
Seo, M., Inoue, I., Tanaka, M., Matsuda, N., Nakano, T., Awata, T., Katayama, S., Alpers, D.H., and Komoda, T. (2013). Clostridium butyricum Miyairi 588 improves high-fat diet-induced non-alcoholic fatty liver disease in rats. Dig. Dis. Sci. 58(12), 3534-3544.
Setlow, B., Cowan, A. E., and Setlow, P. (2003). Germination of spores of Bacillus subtilis with dodecylamine. Journal of Applied Microbiology 95(3), 637-648.
Setlow, B., Yu, J., Li, Y.-Q., and Setlow, P. (2013). Analysis of the germination kinetics of individual Bacillus subtilis spores treated with hydrogen peroxide or sodium hypochlorite. Letters in Applied Microbiology 57(4), 259-265.
Shafaat, H.S., and Ponce, A. (2006). Applications of a Rapid Endospore Viability Assay for Monitoring UV Inactivation and Characterizing Arctic Ice Cores. Appl. Environ Microbiol 72(10), 6808-6814.
Shah, I.M., Laaberki, M.-H., Popham, D.L., and Dworkin, J. (2008). A eukaryotic-like Ser/Thr kinase signals bacteria to exit dormancy in response to peptidoglycan fragments. Cell 135(3), 486-496.
Shah, N.P., "Symposium: Probiotic Bacteria: Probiotic Bacteria: Selective Enumeration and Survival in Dairy Foods," Oct. 7, 1999, 14 pages.
Shah, N.P. et al., "Microencapsulation of Probiotic Bacteria and Their Survival in Frozen Fermented Dairy Desserts," The Australian Journal of Dairy Technology, Oct. 2000, pp. 139-144, vol. 55, No. 3.

(56) References Cited

OTHER PUBLICATIONS

Shah, S. (2012). Clostridium difficile in inflammatory Bowel Disease: a dangerous mix (Clostridium difficile Symposium, Miriam Hospital, Providence, RI).
Shahinas, D., Silverman, M., Sittler, T., Chiu, C., Kim, P., Allen-Vercoe, E., Weese, S., Wong, A., Low, D.E., and Pillai, D.R. (2012). Toward an Understanding of Changes in Diversity Associated with Fecal Microbiome Transplantation Based on 16S rRNA Gene Deep Sequencing. mBio 3(5), e00338-12-e00338-12.
Sharpe, E.S., Nickerson, K.W., Bulla Jr, L.A., and Aronson, J.N. (1975). Separation of spores and parasporal crystals of Bacillus thuringiensis in gradients of certain x-ray contrasting agents. Applied Microbiology 30(6), 1052.
Sheu, T.-Y., Marshall, R.T., and Heymann, H. (1993). Improving Survival of Culture Bacteria in Frozen Desserts by Microentrapment. Journal of Dairy Science 76(7), 1902-1907.
Siaterlis, A., Deepika, G., and Charalampopoulos, D. (2009). Effect of culture medium and cryoprotectants on the growth and survival of probiotic lactobacilli during freeze drying. Letters in Applied Microbiology 48(3), 295-301.
Sigma-Tau. VSL#3. <http://www.vsl3.com/> Accessed Mar. 21, 2014.
Skaar, E., "The Battle for Iron Between Bacterial Pathogens and Their Vertebrate Hosts," PLoS Pathog., Aug. 12, 2010, pp. 1-4, vol. 6, No. 8.
Sleator, R.D. et al.,"Designer Probiotics: A Potential Therapeutic for Clostridium difficile?" Journal of Medical Microbiology, Jun. 2008, pp. 793-794, vol. 57, No. 6.
Snitkin, E.S., Zelazny, A.M., Thomas, P.J., Stock, F., Henderson, D.K., Palmore, T.N., and Segre, J.A. (2012). Tracking a Hospital Outbreak of Carbapenem-Resistant Klebsiella pneumoniae with Whole-Genome Sequencing. Sci Transl Med 4(148), 148ra116-148ra116.
Solanki, H.K., Pawar, D.D., Shah, D.A., Prajapati, V.D., Jani, G.K., Mulla, A.M., and Thakar, P.M. (2013). Development of Microencapsulation Delivery System for Long-Term Preservation of Probiotics as Biotherapeutics Agent. BioMed Research International 2013, 1-21.
SOP No. MB-28-00. <http://www.epa.gov/pesticides/methods/MB-28-00.pdf> Accessed Mar. 27, 2014.
Sorg, J.A., and Sonenshein, A.L. (2008). Bile Salts and Glycine as Cogerminants for Clostridium difficile Spores. J Bacteriol 190(7), 2505-2512.
Sow, H., Desbiens, M., Morales-Rayas, R., Ngazoa, S.E., and Jean, J. (2011). Heat Inactivation of Hepatitis A Virus and a Norovirus Surrogate in Soft-Shell Clams (*Mya arenaria*). Foodborne Pathogens and Disease 8(3), 387-393.
Stams, A.J.M., Van Dijk, J.B., Dijkema, C., and Plugge, C.M. (1993). Growth of Syntrophic Propionate-Oxidizing Bacteria with Fumarate in the Absence of Methanogenic Bacteria. Appl Environ Microbiol 59(4), 1114-1119.
Stevens, K.A., and Jaykus, L.-A. (2004). Bacterial Separation and Concentration from Complex Sample Matrices: A Review. Critical Reviews in Microbiology 30(1), 7-24.
Su, W.J., Waechter, M.J., Bourlioux, P., Dolegeal, M., Fourniat, J., and Mahuzier, G. (1987). Role of volatile fatty acids in colonization resistance to Clostridium difficile in gnotobiotic mice. Infect. Immun. 55(7), 1686-1691.
Stefka, A.T. et al., "Commensal Bacteria Protect Against Food Allergen Sensitization," PNAS, Sep. 9, 2014, pp. 13145-13150, vol. 111, No. 36.
Talwalkar, A., and Kailasapathy, K. (2003). Effect of microencapsulation on oxygen toxicity in probiotic bacteria. Australian Journal of Dairy Technology 58(1), 36-39.
Tamir, H., and Gilvarg, C. (1966). Density Gradient Centrifugation for the Separation of Sporulating Forms of Bacteria. J. Biol. Chem. 241(5), 1085-1090.
Tanaka, M. et al., "Increased Fasting Plasma Ghrelin Levels in Patients with Bulimia Nervosa," European Journal of Endocrinology, Jun. 2002, pp. 1-3, vol. 146.

Taur, Y., and Pamer, E.G. (2014). Harnessing Microbiota to Kill a Pathogen: Fixing the microbiota to treat Clostridium difficile infections. Nature Medicine 20(3), 246-247.
Taur, Y., Xavier, J.B., Lipuma, L., Ubeda, C., Goldberg, J., Gobourne, A., Lee, Y.J., Dubin, K.A., Socci, N.D., Viale, A., et al. (2012). Intestinal Domination and the Risk of Bacteremia in Patients Undergoing Allogeneic Hematopoietic Stem Cell Transplantation. Clin Infect Dis 55(7), 905-914.
The Human Microbiome Project Consortium (2012). Structure, function and diversity of the healthy human microbiome. Nature 486(7402), 207-214.
Tisa, L.S., Koshikawa, T., and Gerhardt, P. (1982). Wet and dry bacterial spore densities determined by buoyant sedimentation. Applied and Environmental Microbiology 43(6), 1307-1310.
Tvede, M., and Rask-Madsen, J. (1989). Bacteriotherapy for chronic relapsing Clostridium difficile diarrhoea in six patients. Lancet 1(8648), 1156-1160.
Ubeda, C., Bucci, V., Caballero, S., Djukovic, A., Toussaint, N.C., Equinda, M., Lipuma, L., Ling, L., Gobourne, A., No, D., et al. (2013). Intestinal Microbiota Containing Barnesiella Species Cures Vancomycin-Resistant Enterococcus faecium Colonization. Infect. Immun. 81(3), 965-973.
Ubeda, C., Taur, Y., Jenq, R.R., Equinda, M.J., Son, T., Samstein, M., Viale, A., Socci, N.D., Van Den Brink, M.R.M., Kamboj, M., et al. (2010). Vancomycin-resistant Enterococcus domination of intestinal microbiota is enabled by antibiotic treatment in mice and precedes bloodstream invasion in humans. Journal of Clinical Investigation 120(12), 4332-4341.
United States Office Action, U.S. Appl. No. 14/313,828, dated Aug. 13, 2014, 5 pages.
United States Office Action, U.S. Appl. No. 14/313,828, dated Dec. 10, 2014, 7 papges.
United States Office Action, U.S. Appl. No. 14/313,828, dated May 15, 2015, 11 pages.
United States Office Action, U.S. Appl. No. 14/221,190, dated Jul. 22, 2014, 19 pages.
United States Office Action, U.S. Appl. No. 14/091,201, dated Mar. 25, 2014, 19 pages.
United States Office Action, U.S. Appl. No. 14/197,044, dated Aug. 13, 2014, 5 pages.
United States Office Action, U.S. Appl. No. 14/592,481, dated Dec. 22, 2015, 21 pages.
United States Office Action, U.S. Appl. No. 15/068,438, dated Apr. 28, 2016, 9 pages.
United States Office Action, U.S. Appl. No. 14/884,655, dated May 5, 2016, 10 pages.
United States Office Action, U.S. Appl. No. 14/884,655, dated Aug. 17, 2016, 9 pages.
United States Office Action, U.S. Appl. No. 14/765,812, dated Aug. 25, 2016, 10 pages.
Van Der Woude, M.W., and Baumler, A.J. (2004). Phase and Antigenic Variation in Bacteria. Clin Microbiol Rev 17(3), 581-611.
Van Immerseel, F. et al., "Butyric Acid-Producing Anaerobic Bacteria as a Novel Probiotic Treatment Approach for Inflammatory Bowel Disease," Journal of Medical Microbiology, JMM Editorial, 2010, pp. 141-143.
Van Kregten, E., Westerdaal, N.A., and Willers, J.M. (1984). New, simple medium for selective recovery of Klebsiella pneumoniae and Klebsiella oxytoca from human feces. J Clin Microbiol 20(5), 936-941.
Van Nood, E., Vrieze, A., Nieuwdorp, M., Fuentes, S., Zoetendal, E.G., De Vos, W.M., Visser, C.E., Kuijper, E.J., Bartelsman, J.F.W. M., Tijssen, J.G.P., et al. (2013). Duodenal Infusion of Donor Feces for Recurrent Clostridium difficile. New England Journal of Medicine 368(5), 407-415.
Vandenplas, Y., Veereman, G., Van Der Werff Ten Bosch, J., Goossens, A., Pierard, D., Samsom, J.N., and Escher, J.C. (2014). Fecal Microbial Transplantation in a One-Year-Old Girl with Early Onset Colitis—Caution Advised: Journal of Pediatric Gastroenterology and Nutrition 1.

(56) References Cited

OTHER PUBLICATIONS

Vidal, M., Forestier, C., Charbonnel, N., Henard, S., Rabaud, C., and Lesens, O. (2010). Probiotics and Intestinal Colonization by Vancomycin-Resistant Enterococci in Mice and Humans. J Clin Microbiol 48(7), 2595-2598.

Villano, S.A., Seiberling, M., Tatarowicz, W., Monnot-Chase, E., and Gerding, D.N. (2012). Evaluation of an Oral Suspension of VP20621, Spores of Nontoxigenic Clostridium difficile Strain M3, in Healthy Subjects. Antimicrobial Agents and Chemotherapy 56(10), 5224-5229.

Wagman, J., and Weneck, E.J. (1963). Preservation of bacteria by circulating-gas freeze drying. Applied Microbiology 11(3), 244-248.

Waites, W.M., and Wyatt, L.R. (1971). Germination of spores of Clostridium bifermentans by certain amino acids, lactate and pyruvate in the presence of sodium or potassium ions. J. Gen. Microbiol. 67(2), 215-222.

Waites, W.M., and Wyatt, L.R. (1974). The effect of pH, germinants and temperature on the germination of spores of Clostridium bifermentans. J. Gen. Microbiol. 80(1), 253-258.

Walker, A.W., and Lawley, T.D. (2012). Therapeutic modulation of intestinal dysbiosis. Pharmacological Research 69(1), 75-86.

Wang, M. et al., "Comparison of Bacterial Diversity Along the Human Intestinal Tract by Direct Cloning and Sequencing of 16S rRNA Genes," FEMS Microbiology Ecology, 2005, pp. 219-231, vol. 54.

Wang, S., and Curtiss III, R. (2014). Development of *Streptococcus pneumoniae* Vaccines Using Live Vectors. Vaccines 2(1), 49-88.

Weingarden, A.R., Chen, C., Bobr, A., Yao, D., Lu, Y., Nelson, V.M., Sadowsky, M.J., and Khoruts, A. (2013). Microbiota transplantation restores normal fecal bile acid composition in recurrent Clostridium difficile infection. AJP: Gastrointestinal and Liver Physiology 306(4), G310-G319.

Wiencek, K.M. et al., "Hydrophobicity of Bacillus and Clostridium Spores," Applied and Environmental Microbiology, Sep. 1990, pp. 2600-2605, vol. 56, No. 9.

Wilson, K.H., and Sheagren, J.N. (1983). Antagonism of toxigenic Clostridium difficile by nontoxigenic C. difficile. Journal of Infectious Diseases 147(4), 733.

Wilson, K.H., Silva, J., and Fekety, F.R. (1981). Suppression of Clostridium difficile by Normal Hamster Cecal Flora and Prevention of Antibiotic-Associated Cecitis. Infect Immun 34(2), 626-628.

Wilson, K. et al., "Role of Competition for Nutrients in Suppression of Clostridium difficile by the Colonic Microflora," Infection and Immunity, Oct. 1988, pp. 2610-2614, vol. 56, No. 10.

Woo, T.D.H., Oka, K., Takahashi, M., Hojo, F., Osaki, T., Hanawa, T., Kurata, S., Yonezawa, H., and Kamiya, S. (2011). Inhibition of the cytotoxic effect of Clostridium difficile in vitro by Clostridium butyricum MIYAIRI 588 strain. J. Med. Microbiol. 60(Pt 11), 1617-1625.

Wróbel, B. (2008). Statistical measures of uncertainty for branches in phylogenetic trees inferred from molecular sequences by using model-based methods. J. Appl. Genet. 49(1), 49-67.

Wroblewski, D., Hannett, G.E., Bopp, D.J., Dumyati, G.K., Halse, T.A., Dumas, N.B., and Musser, K.A. (2009). Rapid Molecular Characterization of Clostridium difficile and Assessment of Populations of C. difficile in Stool Specimens. Journal of Clinical Microbiology 47(7), 2142-2148.

Yamakawa, K. et al., "Enhancement of Clostridium difficile Toxin Production in Biotin-Limited Conditions," J. Med. Microbiol., Feb. 1996, pp. 111-114, vol. 44, No. 2.

Yamamura, H., Hayakawa, M., and Iimura, Y. (2003). Application of sucrose-gradient centrifugation for selective isolation of *Nocardia* spp. from soil. Journal of Applied Microbiology 95(4), 677-685.

Yang, W.-W., and Ponce, A. (2009). Rapid endospore viability assay of Clostridium sporogenes spores. International Journal of Food Microbiology 133(3), 213-216.

Yang, W.-W., and Ponce, A. (2011). Validation of a Clostridium Endospore Viability Assay and Analysis of Greenland Ices and Atacama Desert Soils. Appl. Environ. Microbiol. 77(7), 2352-2358.

Yang, W.-W., Crow-Willard, E.N., and Ponce, A. (2009). Production and characterization of pure Clostridium spore suspensions. J. Appl. Microbiol. 106(1), 27-33.

Yang, W.W. (2010). Fast Viability Assessment of Clostridium Spores Survival in Extreme Environments. PhD thesis California Institute of Technology.

Yi, X., and Setlow, P. (2010). Studies of the Commitment Step in the Germination of Spores of *Bacillus* Species. J. Bacteriol. 192(13), 3424-3433.

Yung, P.T., and Ponce, A. (2008). Fast Sterility Assessment by Germinable-Endospore Biodosimetry. Appl. Environ. Microbiol. 74(24), 7669-7674.

Yunoki, M., Tsujikawa, M., Urayama, T., Sasaki, Y., Morita, M., Tanaka, H., Hattori, S., Takechi, K., and Ikuta, K. (2003). Heat sensitivity of human parvovirus B19. Vox Sanguinis 84(3), 164-169.

Zeng, Y., Fan, H., Chiueh, G., Pham, B., Martin, R., Lechuga-Ballesteros, D., Truong, V.L., Joshi, S.B., and Middaugh, C.R. (2009). Towards development of stable formulations of a live attenuated bacterial vaccine: a preformulation study facilitated by a biophysical approach. Hum Vaccin 5(5), 322-331.

Zhao, J., Krishna, V., Moudgil, B., and Koopman, B. (2008). Evaluation of endospore purification methods applied to Bacillus cereus. Separation and Purification Technology 61(3), 341-347.

European Examination Report, European Application No. 14821918.1, dated Jan. 29, 2018, 4 pages.

Hickson, M. et al., "Probiotics in the Prevention of Antibiotic-Associated Diarrhoea and Clostridium Difficile Infection," Therapeutic Advances in Gastroenterology, 2011, pp. 185-197, vol. 4, No. 3.

Japanese Office Action, Japanese Application No. P2016-502561, dated Feb. 6, 2018, 10 pages.

Jordan, F. et al., "Network Ecology: Topological Constraints on Ecosystem Dynamics," Physics of Life Reviews, Dec. 2004, pp. 139-172, vol. 1, Issue 3 (Abstract Only).

New Zealand Third Examination Report, New Zealand Application No. 713298, dated Feb. 15, 2018, 6 pages.

New Zealand Fourth Examination Report, New Zealand Application No. 713298, dated Mar. 15, 2018, 2 pages.

Papadimitriou, K. et al., "Discovering Probiotic Microorganisms: In Vitro, In Vivo, Genetic and Omics Approaches," Frontiers in Microbiology, Feb. 17, 2015, pp. 1-28, vol. 6, Article 58.

Pillai, A. et al., "Probiotics for Treatment of Clostridium Difficile-Associated Colitis in Adults (Review)," Cochrane Database of Systematic Reviews, The Cochrane Collaboration, John Wiley & Sons, Ltd., 2010, 18 pages.

Russian Second Office Action, Russian Application No. 2015124366, dated Feb. 12, 2018, 10 pages.

Australian First Examination Report, Australian Application No. 2014232370, dated Oct. 19, 2017, 4 pages.

Australian First Examination Report, Australian Application No. 2014212004, dated Sep. 21, 2017, 6 pages.

Chinese First Office Action, Chinese Application No. 201480019395.8, dated Jul. 17, 2017, 29 pages.

European Partial Supplementary Search Report, European Application No. 14870947.0, dated Jul. 11, 2017, 14 pages.

European Extended Search Report, European Application No. 14870947.0, dated Oct. 17, 2017, 11 pages.

European Examination Report, European Application No. 14745749.3, dated Oct. 31, 2017, 3 pages.

European Examination Report, European Application No. 14746455.6, dated Oct. 31, 2017, 6 pages.

European Examination Report, European Application No. 14763266.5, dated Nov. 13, 2017, 4 pages.

European Examination Report, European Application No. 14768281.9, dated Dec. 18, 2017, 4 pages.

European Examination Report, European Application No. 14745792.3, dated Dec. 21, 2017, 6 pages.

Japanese First Office Action, Japanese Application No. P2015-544179, dated Sep. 19, 2017, 8 pages.

Japanese Office Action, Japanese Application No. 2015-556241, dated Sep. 26, 2017, 12 pages.

(56) References Cited

OTHER PUBLICATIONS

Japanese Office Action, Japanese Application No. 2015-556240, dated Oct. 3, 2017, 8 pages.

Kim, J.Y. et al., "Effect of Oral Probiotics (Bifidobacterium lactis AD011 and Lactobacillus acidophilus AD031) Administration on Ovalbumin-Induced Food Allergy Mouse Model," J. Microbiol. Biotechnol., 2008, pp. 1393-1400, vol. 18, No. 8.

Li, A-D. et al., "Clinical Features and Bacterial Culture on Stools of Patients with Acute Diarrhea," Chinese Journal of Health Laboratory Technology, Mar. 10, 2012, pp. 559-561, vol. 2, No. 6.

New Zealand Examination Report, New Zealand Application No. 713298, dated Sep. 26, 2017, 5 pages.

Pharmacy, 2011, pp. 79-86, vol. 62, No. 3. [With English Main Sub-Points].

Prioult, G. et al., "Effect of Probiotic Bacteria on Induction and Maintenance of Oral Tolerance to β-Lactoglobulin in Gnotobiotic Mice," Clinical and Diagnostic Laboratory Immunology, Sep. 2003, pp. 787-792, vol. 10, No. 5.

Rehman, A. et al., "Effect of Probiotics and Antibiotics on the Intestinal Homeostasis in a Computer Controlled Model of the Large Intestine," BMC Microbiology, 2012, 10 pages, vol. 12, No. 47.

United States Office Action, U.S. Appl. No. 14/777,252, dated Aug. 29, 2017, 16 pages.

United States Office Action, U.S. Appl. No. 15/104,873, dated Oct. 17, 2017, 7 pages.

United States Office Action, U.S. Appl. No. 14/765,812, dated Dec. 7, 2017, 10 pages.

United States Office Action, U.S. Appl. No. 14/765,810, dated Jan. 8, 2018, 8 pages.

United States Office Action, U.S. Appl. No. 14/765,810, dated Jan. 25, 2018, 11 pages.

Yuguchi Hiroya et al., "Hakkonyuu/nyuusankin inryou to chounaikinsou "Fermented Milk/Lactic Acid Bacteria Beverages and Intestinal Bacterial Flora,"" New Food Industry, UDA, Moritaka, New Food Industry K.K., 1987, pp. 71-88, vol. 29, No. 7. [With English Subtitle Translations].

\* cited by examiner

```
   1 AAATTGAAGAGTTTGATCATGGCTCAGATTGAACGCTGGCGGCAGGCCTA
  51 ACACATGCAAGTCGAACGGTAACAGGAAGAAGCTTGCTCTTTGCTGACGA
 101 GTGGCGGACGGGTGAGTAATGTCTGGGAAACTGCCTGATGGAGGGGGATA
 151 ACTACTGGAAACGTAGCTAATACCGCATAACGTCGCAAGACCAAAGAGGG
 201 GGGACCTTCGGGCCTCTTGCCATCGGATGTGCCCAGATGGGATTAGCTAG
 251 TAGGTGGGGTAACGGCTCACCTAGGCGACGATCCCTAGCTGTTCTGAGAG
 301 GATGACCAGCCACACTGGAACTGAGACACGGTCCAGACTCCTACGGGAGG
 351 CAGCAGTGGGGAATATTGCACAATGGGCGCAAGCCTGATGCAGCCATGCC
 401 GCGTGTATGAAGAAGGCCTTCGGGTTGTAAAGTACTTTCAGCGGGGAGGA
 451 AGGGAGTAAAGTTAATACCTTTGCTCATTGACGTTACCCGCAGAAGAAGC
 501 ACCGGCTAACTCGTGCCAGCAGCCGCGGTAAACGGAGGGTGCAAGCGT
 551 TAATCGGAATTACTGGGCGTAAAGCGCACGCAGGCGGTTTGTTAAGTCAG
 601 ATGTGAAATCCCCGGGCTCAACCTGGGAACTGCATCTGATACTGGCAAGC
 651 TTGAGTCTCGTAGAGGGGGGTAGAATTCCAGGTGTAGCGGTGAAATGCGT
 701 AGAGATCTGGAGGAATACCGGTGGCGAAGGCGGCCCCCTGGACGAAGACT
 751 CACGTCAGGTGCGAAAGCGTGGGGAGCAAACAGGATTAGATACCCTGGT
 801 AGTCCACGCCGTAAACGATGTCGACTTGGAGGTTGTGCCCTTGAGGCGTG
 851 GCTTCCGGAGCTAACGCGTTAAGTCGACCGCCTGGGGAGTACGGCCGCAA
 901 GGTTAAAACTCAAATGAATTGACGGGGGCCCGCACAAGCGGTGGAGCATG
 951 TGGTTTAATTCGATGCAACGCGAAGAACCTTACCTGGTCTTGACATCCAC
1001 GGAAGTTTTCAGAGATGAGAATGTGCCTTCGGGAACCGTGAGACAGGTGC
1051 TGCATGGCTGTCGTCAGCTCGTGTTGTGAAATGTTGGGTTAAGTCCCGCA
1101 ACGAGCGCAACCCTTATCCTTTGTTGCCAGCGGTCCGGCCGGGAACTCAA
1151 AGAGACTGCCAGTGCATAAACTGGAGGAAGGTGGGGATGACGTCAAGTCA
1201 TCATGGCCCTTACGACCAGGGCTACACACGTGCTACAATGGCGCATACAA
1251 AGAGAAGCGACCTCGCGAGAGCAAGCGGACCTCATAAAGTGCGTCGTAGT
1301 CCGGATTGGAGTCTGCAACTCGACTCCATGAAGTCGGAATCGCTAGTAAT
1351 CGTGGATCAGAATGCCACGGTGAATACGTTCCCGGGCCTTGTACACACCG
1401 CCCGMCACCACCATGGGAGTGGTTGCAAAAGAAGTAGGTAGCTTAACCTT
1451 CGGGAGGGCGCTTACCACTTTGTGATTCATGACTGGGGTGAAGTCGTAAC
1501 AAGGTAACCGTAGGGGAACCTGCGGTTGGATCACCTCCTTA
```

FIG. 3

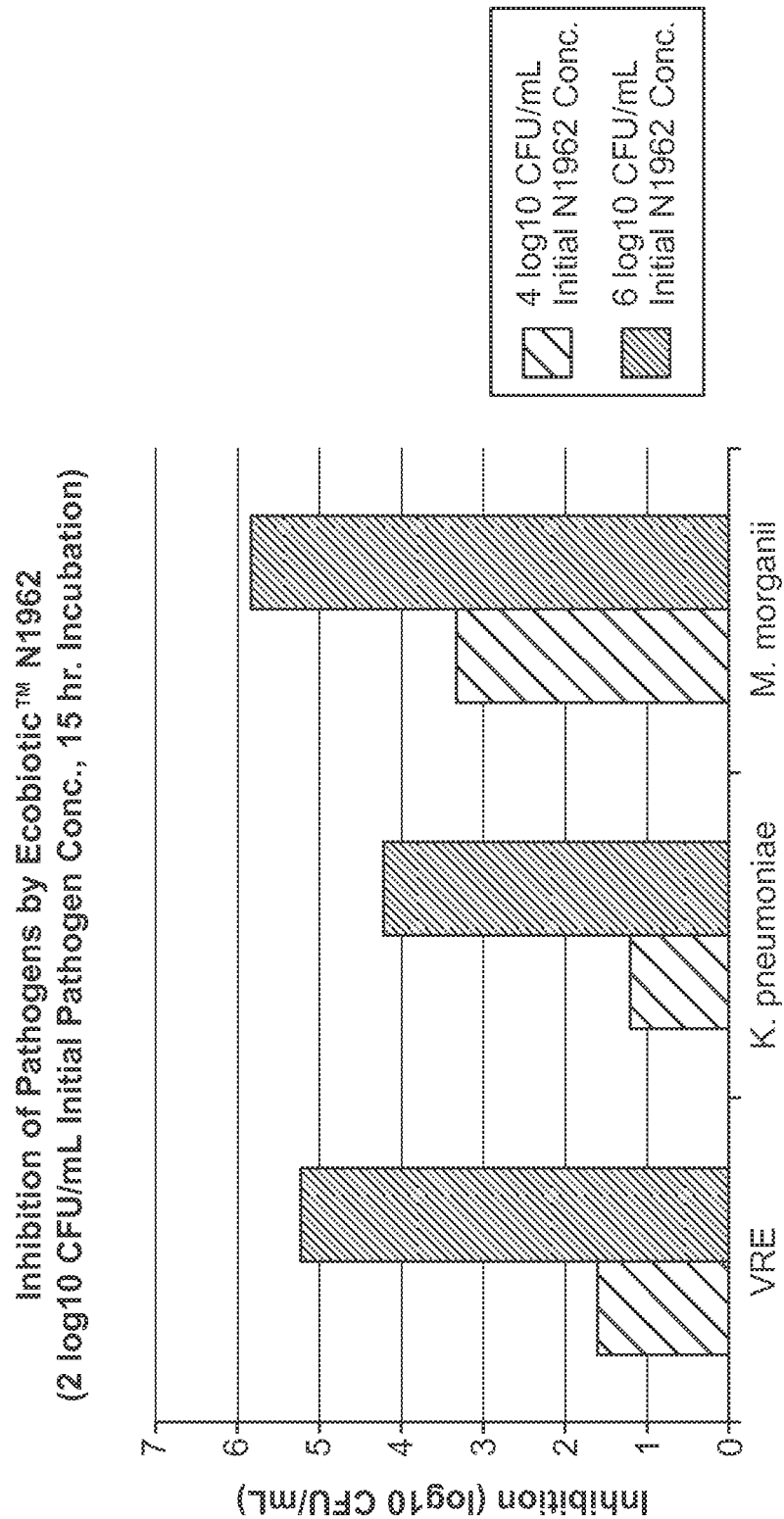

SYNERGISTIC BACTERIAL COMPOSITIONS AND METHODS OF PRODUCTION AND USE THEREOF

RELATED APPLICATIONS

This application is related to co-owned International Application No. PCT/US13/71758, filed Nov. 25, 2013, titled "SYNERGISTIC BACTERIAL COMPOSITIONS AND METHODS OF PRODUCTION AND USE THEREOF" both which claim priority to U.S. Provisional Patent Application Ser. No. 61/729,518, filed Nov. 23, 2012, U.S. Provisional Patent Application Ser. No. 61/729,519, filed Nov. 23, 2012, U.S. Provisional Patent Application Ser. No. 61/729,520, filed Nov. 23, 2012, U.S. Provisional Patent Application Ser. No. 61/729,521, filed Nov. 23, 2012, U.S. Provisional Patent Application Ser. No. 61/729,522, filed Nov. 23, 2012, U.S. Provisional Patent Application Ser. No. 61/729,524, filed Nov. 23, 2012, U.S. Provisional Patent Application Ser. No. 61/729,515, filed Nov. 23, 2012, U.S. Provisional Patent Application Ser. No. 61/729,517, filed Nov. 23, 2012, U.S. Provisional Patent Application Ser. No. 61/729,525, filed Nov. 23, 2012, U.S. Provisional Patent Application Ser. No. 61/729,526, filed Nov. 23, 2012, U.S. Provisional Patent Application Ser. No. 61/729,527, filed Nov. 23, 2012; U.S. Provisional Patent Application Ser. No. 61/908,698, filed Nov. 25, 2013; U.S. Provisional Patent Application Ser. No. 61/908,702, filed Nov. 25, 2013; and U.S. patent application Ser. No. 14/091,201, filed Nov. 26, 2013, the entire disclosures of which are hereby incorporated by reference in their entirety for all purposes.

This application is the National Stage of International Application No. PCT/US2014/067491, filed Nov. 25, 2014, which claims the benefit of U.S. Provisional Patent Application Ser. No. 61/908,698, titled "Synergistic Bacterial Compositions and Methods of Production and Use Thereof" filed Nov. 25, 2013; U.S. Provisional Patent Application Ser. No. 61/908,702, titled "Defined Bacterial Compositions and Methods of Production and Use Thereof" filed Nov. 25, 2013; and U.S. Provisional Patent Application Ser. No. 62/004,187, titled "Synergistic Bacterial Compositions and Methods of Production and Use Thereof" filed May 28, 2014, the entire disclosures of which are hereby incorporated by reference in their entirety for all purposes.

REFERENCE TO A SEQUENCE LISTING

This application includes a Sequence Listing with 2047 sequences and is submitted electronically as a text file named 28155US_CRF_sequencelisting.txt, created on Nov. 17, 2016, with a size of 4,152,796 bytes. The sequence listing is incorporated by reference.

BACKGROUND

Mammals are colonized by microbes in the gastrointestinal (GI) tract, on the skin, and in other epithelial and tissue niches such as the oral cavity, eye surface and vagina. The gastrointestinal tract harbors an abundant and diverse microbial community. It is a complex system, providing an environment or niche for a community of many different species or organisms, including diverse strains of bacteria. Hundreds of different species may form a commensal community in the GI tract in a healthy person, and this complement of organisms evolves from the time of birth to ultimately form a functionally mature microbial population by about 3 years of age. Interactions between microbial strains in these populations and between microbes and the host, e.g., the host immune system, shape the community structure, with availability of and competition for resources affecting the distribution of microbes. Such resources may be food, location and the availability of space to grow or a physical structure to which the microbe may attach. For example, host diet is involved in shaping the GI tract flora.

A healthy microbiota provides the host with multiple benefits, including colonization resistance to a broad spectrum of pathogens, essential nutrient biosynthesis and absorption, and immune stimulation that maintains a healthy gut epithelium and an appropriately controlled systemic immunity. In settings of 'dysbiosis' or disrupted symbiosis, microbiota functions can be lost or deranged, resulting in increased susceptibility to pathogens, altered metabolic profiles, or induction of proinflammatory signals that can result in local or systemic inflammation or autoimmunity. Thus, the intestinal microbiota plays a significant role in the pathogenesis of many diseases and disorders, including a variety of pathogenic infections of the gut. For example, subjects become more susceptible to pathogenic infections when the normal intestinal microbiota has been disturbed due to use of broad-spectrum antibiotics. Some of these diseases and disorders are chronic conditions that significantly decrease a subject's quality of life and ultimately some can be fatal.

Fecal transplantation has been shown to sometimes be an effective treatment for subjects suffering from severe or refractory GI infections and other disorders by repopulating the gut with a diverse array of microbes that control key pathogens by creating an ecological environment inimical to their proliferation and survival. Such approaches have demonstrated potential to decrease host susceptibility to infection. Fecal transplantation, however, is generally used only for recurrent cases because it has the potential to transmit infectious or allergenic agents between hosts, involves the transmission of potentially hundreds of unknown strains from donor to subject, and is difficult to perform on a mass scale. Additionally, fecal transplantation is inherently non-standardized and different desired and/or undesired material may be transmitted in any given donation. Thus, there is a need for defined compositions that can be used to decrease susceptibility to infection and/or that facilitate restoration of a healthy gut microbiota.

In addition, practitioners have a need for safe and reproducible treatments for disorders currently treated on an experimental basis using fecal transplantation. Summary of the invention To meet the need for safe, reproducible treatments for disorders that can be modulated by the induction of a healthy GI microbiome and to treat diseases associated with the GI microbiome, Applicants have designed bacterial compositions of isolated bacterial strains with a plurality of functional properties, in particular that are useful for treating dysbiosis (e.g., restoring a GI microbiome to a state of health), and for treating disorders associated with infection or imbalance of microbial species found in the gut that are based on Applicants discoveries related to those bacterial strains and analysis and insights into properties related to those strains and combinations of those strains, leading to the inventions disclosed herein.

In a first aspect, provided are compositions comprising an effective amount of a bacterial composition comprising at least a first type of isolated bacterium capable of forming a spore, a second type of isolated bacterium capable of forming a spore and optionally a third type of isolated bacterium capable of forming a spore, wherein the first type, the second type and the optional third type are not identical, and wherein at least two of the first type, the second type and the optional third type are capable of synergistically decreasing and/or inhibiting the growth and/or colonization of at least one type of pathogenic bacteria. In some embodiments, the bacterial composition comprises at least about 2, 3, 4, 5, 6, 7, 8, 9, 10, 11, 12, 13, 14, 15, 16, 17, 18, 19 or 20 types of isolated bacteria capable of forming spores. In other embodiments, the bacterial composition comprises at least about 2, 3, 4, 5, 6, 7, 8, 9, 10, 11, 12, 13, 14, 15, 16, 17, 18, 19 or 20 types of isolated bacteria not containing at least one sporulation-associated gene. In further embodiments, the bacterial composition comprises at least about 2, 3, 4, 5, 6, 7, 8, 9, 10, 11, 12, 13, 14, 15, 16, 17, 18, 19 or 20 types of isolated bacteria in spore form. In further embodiments, the bacterial composition comprises at least about 2, 3, 4, 5, 6, 7, 8, 9, 10, 11, 12, 13, 14, 15, 16, 17, 18, 19 or 20 types of isolated bacteria in vegetative form. In further embodiments, the bacterial composition comprises at least about 2, 3, 4, 5, 6, 7, 8, 9, 10, 11, 12, 13, 14, 15, 16, 17, 18, 19 or 20 types of isolated bacteria in spore form, and wherein the bacterial composition further comprises at least about 2, 3, 4, 5, 6, 7, 8, 9, 10, 11, 12, 13, 14, 15, 16, 17, 18, 19 or 20 types of isolated bacteria in vegetative form. In further embodiments, the bacterial composition comprises at least about 5 types of isolated bacteria and at least about 20% of the isolated bacteria are capable of forming spores or are in spore form. In further embodiments, the bacterial composition comprises at least about 5 types of isolated bacteria and at least 2 of the isolated bacteria are capable of forming spores or are in spore form. In further embodiments, the first type, second type and optional third type are present in the composition in approximately equal concentrations. In further embodiments, the first type and the third type are present in the composition in approximately equal concentrations. In further embodiments, the second type and the third type are present in the composition in approximately equal concentrations. In further embodiments, the first type is present in the composition in at least about 150% the concentration of the second type and/or the third type. In further embodiments, the first type, second type and optional third type are individually present in the composition in at least about 150% the concentration of the third type. In further embodiments, the composition consists essentially of between two and about twenty types of isolated bacteria, wherein at least two types of the isolated bacteria are independently capable of spore formation. In further embodiments, at least two types of the isolated bacteria are in spore form. In further embodiments, the first, second and third types are independently selected from Table 1. In further embodiments, the first, second and third types comprise an operational taxonomic unit (OTU) distinction. In further embodiments, the OTU distinction comprises 16S rRDNA sequence similarity below about 95% identity. In further embodiments, the first, second and third types independently comprise bacteria that comprise 16S rDNA sequence at least 95% identical to 16S rDNA sequence present in a bacterium selected from Table 1.

In another aspect, provided are compositions comprising an effective amount of a bacterial composition comprising a first type of isolated bacterium; a second type of isolated bacterium; and a third type of isolated bacterium, wherein at least one of the first, second and third types are capable of forming a spore, wherein the first, second and third types are not identical, and wherein a combination of at least two of the first, second and third types are inhibitory to at least one type of pathogenic bacteria. In some embodiments, a combination of the first, second and third types is capable of being inhibitory to the pathogenic bacterium. In other embodiments, a combination of the first, second and third types is capable of being cytotoxic or cytostatic to the pathogenic bacterium. In further embodiments, a combination of the first, second and third types is capable of being cytotoxic or cytostatic to the pathogenic bacterium. In further embodiments, a combination of the first, second and third types is capable of inhibiting proliferation of the pathogenic bacterial present at a concentration at least equal to the concentration of the combination of the first, second and third types. In further embodiments, the pathogenic bacterium is selected from the group consisting of *Yersinia, Vibrio, Treponema, Streptococcus, Staphylococcus. Shigella. Salmonella, Rickettsia, Pseudomonas, Neisseria, Mycoplasma, Mycobacterium, Listeria, Leptospira, Legionella, Helicobacter, Haemophilus, Francisella, Escherichia, Enterococcus, Klebsiella, Corynebacterium, Clostridium, Chlamydia, Chlamydophila, Campylobacter, Brucella, Borrelia*, and *Bordetella*. In further embodiments, the first, second and third types synergistically interact. In further embodiments, at least one of the first, second and third types are capable of independently forming a spore. In further embodiments, at least two of the first, second and third types are capable of independently forming a spore. In further embodiments, the first, second and third types are capable of independently forming a spore.

In further embodiments, wherein the first, second and third types are capable of functionally populating the gastrointestinal tract of a human subject to whom the composition is administered. In further embodiments, the functional populating of the gastrointestinal tract comprises preventing a dysbiosis of the gastrointestinal tract. In further embodiments, the functional populating of the gastrointestinal tract comprises treating a dysbiosis of the gastrointestinal tract. In further embodiments, the functional populating of the gastrointestinal tract comprises reducing the severity of a dysbiosis of the gastrointestinal tract. In further embodiments, the functional populating of the gastrointestinal tract comprises reducing one or more symptoms of a dysbiosis of the gastrointestinal tract. In further embodiments, the functional populating of the gastrointestinal tract comprises preventing colonization of the gastrointestinal tract by a pathogenic bacterium. In further embodiments, the functional populating of the gastrointestinal tract comprises reducing colonization of the gastrointestinal tract by a pathogenic bacterium. In further embodiments, the functional populating of the gastrointestinal tract comprises reducing the number of one or more types of pathogenic bacteria in the gastrointestinal tract. In further embodiments, the functional populating of the gastrointestinal tract comprises increasing the number of one or more non-pathogenic bacteria in the gastrointestinal tract. Also provided are single dose units comprising the bacterial compositions provided herein, for example, dose units comprising at least $1\times10^7$, $1\times10^8$, $1\times10^9$, $1\times10^{10}$, $1\times10^{11}$, or $1\times10^{12}$ colony forming units (CFUs) of viable bacteria. Also provided are pharmaceutical formulations comprising an effective amount of the compositions provided herein, and further comprising an effective amount of an anti-bacterial agent, a pharmaceutical formulation comprising an effective amount of the bacterial composition, and further comprising an effective amount of an anti-fungal agent, a pharmaceutical formulation comprising an effective amount of the bacterial composition, and further comprising an effective amount of an anti-viral agent, and a pharmaceutical formulation comprising an effective amount of the bacterial composition, and further comprising an effective amount of an anti-parasitic agent.

In another aspect, provided are methods comprising administering to a human subject in need thereof an effective amount of the bacterial compositions, and further comprising administering to the human subject an effective amount of an anti-biotic agent. In some embodiments, the bacterial composition and the anti-biotic agent are administered simultaneously. In other embodiments, the bacterial composition is administered prior to administration of the anti-biotic agent. In further embodiments, provided are methods in which the number of pathogenic bacteria present in the gastrointestinal tract of the human subject is not detectably increased or is detectably decreased over a period of time. In other embodiments, the human subject is diagnosed as having a dysbiosis of the gastrointestinal tract. In other embodiments, the human subject is diagnosed as infected with a pathogenic bacterium selected from the group consisting of *Yersinia, Vibrio, Treponema, Streptococcus, Staphylococcus, Shigella, Salmonella, Rickettsia, Pseudomonas, Neisseria, Mycoplasma, Mycobacterium, Listeria, Leptospira, Legionella, Helicobacter, Haemophilus, Francisella, Escherichia, Enterococcus, Klebsiella, Corynebacterium, Clostridium, Chlamydia, Chlamydophila, Campylobacter, Brucella, Borrelia*, and *Bordetella*. In other embodiments, the anti-bacterial agent is administered to the human subject prior to administration of the bacteria composition. In other embodiments, the number of pathogenic bacteria present in or excreted from the gastrointestinal tract of the human subject is detectably reduced within two weeks of administration of the bacterial composition.

In another aspect, provided are methods of functionally populating the gastrointestinal tract of a human subject, comprising administering to the subject an effective amount of the bacterial composition of the present invention, under conditions such that the first, second and third types functionally populate the gastrointestinal tract of the human subject. In some embodiments, the bacterial composition is orally administered, rectally administered, or the combination of orally and rectally administered. In other embodiments, the bacterial composition is topically or nasally administered or inhaled.

Also provided are methods of preparing a comestible product, comprising combining with a comestible carrier the bacterial compositions of the present invention, wherein the comestible product is substantially free of non-comestible materials.

In one aspect, provided are compositions comprising an effective amount of a bacterial composition comprising at least a first type of isolated bacterium capable of forming a spore and a second type of isolated bacterium capable of forming a spore, wherein the first type, second type and optional third type are not identical, and wherein at least one of the first type, second type and optional third type are capable of decreasing and/or inhibiting the growth and/or colonization of at least one type of pathogenic bacteria. In an embodiment, the bacterial composition comprises at least about 3, 4, 5, 6, 7, 8, 9 or 10 types of isolated bacteria. In an embodiment, the bacterial composition comprises at least about 3, 4, 5, 6, 7, 8, 9, or 10 types of isolated bacteria and at least 1, 2, 3, 4, 5, 6, 7, 8, 9, or 10 of the isolated bacteria are capable of forming spores. In an embodiment, the bacterial composition comprise at least about 5 types of isolated bacteria and at least 2 of the isolated bacteria are capable of forming spores. In an embodiment, the bacterial composition comprises i) at least about 3, 4, 5, 6, 7, 8, 9, 10, 11, 12, 13, 14, 15, 16, 17, 18, 19, 20, 21, 22, 23, 24, 25, 26, 27, 28, 29, 30 or more types of isolated bacteria capable of forming spores, ii) at least about 3, 4, 5, 6, 7, 8, 9, 10, 11, 12, 13, 14, 15, 16, 17, 18, 19, 20, 21, 22, 23, 24, 25, 26, 27, 28, 29, 30 or more types of isolated bacteria not known to be capable of forming spores, or iii) any combination of i) and ii). In an embodiment, the first type, the second type and the optional third type are present in the composition in approximately equal concentrations or activity levels. In an embodiment, the first type, the second type and the optional third type are present in the composition in not substantially equal concentrations. In an embodiment, the first type is present in the composition in at least about 150% the concentration of the second type, or wherein the second type is present in the composition in at least about 150% the concentration of the first type. In an embodiment, the composition consists essentially of: i) between two and about twenty types of isolated bacteria, wherein at least two types of isolated bacteria are independently capable of spore formation; ii) between two and about twenty types of isolated bacteria, wherein at least two types of isolated bacteria not known to be capable of spore formation, or iii) any combination of i) and ii). In an embodiment, the first type of isolated bacterium and the second type of isolated bacterium are selected from Table 1. In an embodiment, the first type of isolated bacterium, the second type of isolated bacterium and the optional third type of isolated bacterium comprise an operational taxonomic unit (OTU) distinction. In an embodiment, the OTU distinction comprises 16S rDNA sequence similarity below about 95% identity. In an embodiment, the first type of isolated bacterium and the second type of isolated bacterium independently comprise bacteria that comprise 16S rDNA sequence at least 95% identical to 16S rDNA sequence present in a bacterium selected from Table 1. In an embodiment, a combination of the first type, second type and optional third type are: i) cytotoxic, ii) cytostatic, iii) capable of decreasing the growth of the pathogenic bacterium, iv) capable of inhibiting the growth of the pathogenic bacterium, v) capable of decreasing the colonization of the pathogenic bacterium, vi) capable of inhibiting the colonization of the pathogenic bacterium, or vii) any combination of i)-vi). In an embodiment, the combination is capable of inhibiting proliferation of the pathogenic bacteria present at a concentration at least equal to the concentration of the combination of the first type, the second type and the optional third type. In an embodiment, the combination is capable of inhibiting proliferation of the pathogenic bacterial present at a concentration at least about twice the concentration of the combination of the first type, the second type and the optional third type. In an embodiment, the combination is capable of inhibiting proliferation of the pathogenic bacterial present at a concentration at least about ten times the concentration of the combination of the first type, the second type and the optional third type. In an embodiment, the combination is capable of proliferating in the presence of the pathogenic bacteria. In an embodiment, the pathogenic bacterium is selected from the group consisting of *Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Cotynebacterium, Clostridium, Chlamydia, Chlamydophila, Campylobacter, Burkholderia, Brucella, Borrelia, Bordetella, Bifidobacterium, Bacillus*, multi-drug resistant bacteria, carbapenem-resistant Enterobacteriaceae (CRE), extended spectrum beta-lactam resistant Enterococci (ESBL), and vancomycin-resistant Enterococci (VRE). In an embodiment, the first type, the second type and the optional third type synergistically interact. In an embodiment, the first type, the second type and the optional third type synergistically interact to inhibit the pathogenic bacterium. In an embodiment, the composition comprises a combination of bacteria described in any row of Table 4a or Table 4b, or a combination of bacteria described in any row of Table 4a that has a ++++ or a +++ designation, or a combination of bacteria described in any row of Table 4a that has a $75^{th}$ percentile designation.

In another aspect, provided are compositions comprising an effective amount of a bacterial composition comprising at least a first type of isolated bacterium, a second type of isolated bacterium and an optional third type of isolated bacterium, wherein only one of the first type, the second type and the optional third type is capable of forming a spore, and wherein at least one of the first type, the second type and the optional third type is capable of decreasing the growth and/or colonization of at least one type of pathogenic bacteria.

In another aspect, provided are compositions comprising an effective amount of a bacterial composition comprising at least a first type of isolated bacterium, a second type of isolated bacterium and an optional third type of isolated bacterium, wherein the first type, the second type and the optional third type are not spores or known to be capable of forming a spore, and wherein at least one of the first type, the second type and the optional third type are capable of decreasing the growth and/or colonization of at least one type of pathogenic bacteria.

In an embodiment, at least one of the first type, second type and optional third type are capable of reducing the growth rate of at least one type of pathogenic bacteria. In an embodiment, at least one of the first type, second type and optional third type are cytotoxic to at least one type of pathogenic bacteria. In an embodiment, at least one of the first type, second type and optional third type are cytostatic to at least one type of pathogenic bacteria. In an embodiment, the first type, second type and optional third type are selected from Table 1. In an embodiment, the first type, second type and optional third type comprise different species. In an embodiment, the first type, second type and optional third type comprise different genera. In an embodiment, the first type, second type and optional third type comprise different families. In an embodiment, the first type, second type and optional third type comprise different orders. In an embodiment, the first type, second type and optional third type comprise a combination of bacteria described in any row of Table 4a or Table 4b, a combination of bacteria described in any row of Table 4a that has a ++++ or a +++ designation, or any or of Table 4a that has a $75^{th}$ percentile designation.

In another aspect, provided are compositions comprising an effective amount of a bacterial composition comprising at least a first type of isolated bacterium and a second type of isolated bacterium, wherein: i) the first type, second type and optional third type are independently capable of forming a spore; ii) only one of the first type, second type and optional third type is capable of forming a spore or iii) neither the first type nor the second type is capable of forming a spore, wherein the first type, second type and optional third type are not identical, wherein the first type, second type and optional third type are capable of functionally populating the gastrointestinal tract of a human subject to whom the composition is administered. In an embodiment, the first type, second type and optional third type comprise a combination of bacteria described in any row of Table 4a or Table 4b, a combination of bacteria described in any row of Table 4a that has a ++++ or a +++ designation, or any or of Table 4a that has a $75^{th}$ percentile designation. In an embodiment, the functional populating of the gastrointestinal tract comprises preventing a dysbiosis of the gastrointestinal tract. In an embodiment, the functional populating of the gastrointestinal tract comprises treating a dysbiosis of the gastrointestinal tract. In an embodiment, the functional populating of the gastrointestinal tract comprises reducing the severity of a dysbiosis of the gastrointestinal tract. In an embodiment, the functional populating of the gastrointestinal tract comprises reducing one or more symptoms of a dysbiosis of the gastrointestinal tract. In an embodiment, the functional populating of the gastrointestinal tract comprises preventing growth and/or colonization of the gastrointestinal tract by a pathogenic bacterium. In an embodiment, the functional populating of the gastrointestinal tract comprises reducing growth and/or colonization of the gastrointestinal tract by a pathogenic bacterium. In an embodiment, the functional populating of the gastrointestinal tract comprises reducing the number of one or more types of pathogenic bacteria in the gastrointestinal tract. In an embodiment, the functional populating of the gastrointestinal tract comprises increasing the number of one or more non-pathogenic bacteria in the gastrointestinal tract. In an embodiment, the bacterial composition comprises 0, 1, 2, 3 or greater than 3 types of isolated bacteria capable of forming spores. In an embodiment, the bacterial composition comprises at least about 5 types of isolated bacteria capable of forming spores. In an embodiment, the bacterial composition comprises at least about 7 types of isolated bacteria capable of forming spores. In an embodiment, the first type, second type and optional third type are present in the composition in not substantially equal concentrations. In an embodiment, the first type, second type and optional third type are present in the composition in approximately equal concentrations. In an embodiment, the first type is present in the composition in at least about 150% the concentration of the second type. In an embodiment, the second type is present in the composition in at least about 150% the concentration of the first type. In an embodiment, the composition consists essentially of between two and about ten types of isolated bacteria, wherein at least one type of isolated bacteria are independently capable of spore formation. In an embodiment, the first type of isolated bacterium and the second type of isolated bacterium are selected from Table 1. In an embodiment, the first type of isolated bacterium, the second type of isolated bacterium and the optional third type of isolated bacterium comprise an operational taxonomic unit (OTU) distinction. In an embodiment, the OTU distinction comprises 16S rDNA sequence similarity below about 95% identity. In an embodiment, the first type of isolated bacterium and the second type of isolated bacterium independently comprise bacteria that comprise 16S rDNA sequence at least 95% identical to 16S rDNA sequence present in a bacterium selected from Table 1. In an embodiment, a combination of the first type, second type and optional third type are cytotoxic or cytostatic to the pathogenic bacterium. In an embodiment, the combination is capable of inhibiting proliferation of the pathogenic bacteria present at a concentration at least equal to the concentration of the combination of the first type, second type and optional third type. In an embodiment, the combination is capable of inhibiting proliferation of the pathogenic bacterial present at a concentration at least about twice the concentration of the combination of the first type, second type and optional third type. In an embodiment, the combination is capable of inhibiting proliferation of the pathogenic bacteria present at a concentration at least about ten times the concentration of the combination of the first type, second type and optional third type. In an embodiment, the pathogenic bacterium is selected from the group consisting of Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus, multi-drug resistant bacteria, Carbapenem-resistant Enterobacteriaceae (CRE), extended spectrum beta-lactam resistant Enterococci (ESBL), and vancomycin-resistant Enterococci (VRE). In an embodiment, the first type, second type and optional third type synergistically interact to be cytotoxic to the pathogenic bacterium. In an embodiment, wherein the first type, second type and optional third type synergistically interact to be cytostatic to the pathogenic bacterium.

In another aspect, provided are single dose units comprising the compositions of the present invention. In an embodiment, the dose unit comprises at least $1\times10^4$, $1\times10^5$, $1\times10^6$, $1\times10^7$, $1\times10^8$, $1\times10^9$, $1\times10^{10}$, $1\times10^{11}$ or greater than $1\times10^{11}$ colony forming units (CFUs) of either spores or vegetative bacterial cells. In an embodiment, the dose unit comprises a pharmaceutically acceptable excipient, an enteric coating or a combination thereof. In an embodiment, the dose unit further comprises a drug selected from corticosteroids, mesalazine, mesalamine, sulfasalazine, sulfasalazine derivatives, immunosuppressive drugs, cyclosporin A, mercaptopurine, azathiopurine, prednisone, methotrexate, antihistamines, glucocorticoids, epinephrine, theophylline, cromolyn sodium, anti-leukotrienes, anti-cholinergic drugs for rhinitis, anti-cholinergic decongestants, mast-cell stabilizers, monoclonal anti-IgE antibodies, vaccines, and combinations thereof, wherein the drug is present in an amount effective to modulate the amount and/or activity of at least one pathogen. In an embodiment, the dose unit is formulated for oral administration, rectal administration, or the combination of oral and rectal administration, or is formulated for topical, nasal or inhalation administration. In an embodiment, the dose unit comprises a of bacteria described in any row of Table 4a or Table 4b, a combination of bacteria described in any row of Table 4a that has a ++++ or a +++ designation, or any or of Table 4a that has a 75 percentile designation.

In another aspect, provided are kits comprising in one or more containers: a first purified population of a first type of bacterial spores substantially free of viable vegetal bacterial cells; a second purified population of a second type of bacterial spores substantially free of viable vegetal bacterial cells; and optionally a third purified population of a third type of bacterial spores substantially free of viable vegetal bacterial cells, wherein the first type, second type and optional third type of bacterial spores are not identical, and wherein the first type, second type and optional third type of bacterial spores, when co-localized in a target region of a gastrointestinal tract of a human subject in need thereof, are capable of functionally populating the gastrointestinal tract. In an embodiment, the first purified population and the second purified population are present in a single container. In an embodiment, the first purified population, the second purified population and the optional third purified population present in two or optionally three containers. In an embodiment, the first purified population and the second purified population are lyophilized or substantially dehydrated. In an embodiment, the kit further comprises in one or more containers an effective amount of an anti-bacterial agent, an effective amount of an anti-viral agent, an effective amount of an anti-fungal agent, an effective amount of an anti-parasitic agent, or a combination thereof in one or more containers. In an embodiment, the kit further comprises a pharmaceutically acceptable excipient or diluent. In an embodiment, the first purified population, the second purified population and the optional third purified population comprise a combination of bacteria described in any row of Table 4a or Table 4b, a combination of bacteria described in any row of Table 4a that has a ++++ or a +++ designation, or any or of Table 4a that has a $75^{th}$ percentile designation.

Also provided are pharmaceutical formulations comprising an effective amount of the compositions of the invention, and further comprising an effective amount of an anti-bacterial agent, an effective amount of an anti-fungal agent, an effective amount of an anti-viral agent, an effective amount of an anti-parasitic agent.

Also provided are comestible products comprising a first purified population of a first type of bacterial spores, a second purified population of a second type of bacterial spores and optionally a third purified population of a third type of bacterial spores, wherein the first type, second type and optional third type of bacterial spores are not identical, wherein the comestible product is substantially free of viable vegetal bacterial cells, and wherein the first type, second type and optional third type of bacterial spores, when administered to a human subject in need thereof, are capable of functionally populating the gastrointestinal tract of the human subject. In an embodiment, the comestible product comprises a food or food additive, a beverage or beverage additive, or a medical food. In an embodiment, the comestible product comprises at least $1\times10^4$, $1\times10^5$, $1\times10^6$, $1\times10^7$, $1\times10^8$, $1\times10^9$, $1\times10^{10}$, $1\times10^{11}$ or greater than $1\times10^{11}$ colony forming units (CFUs) of viable spores. In an embodiment, the comestible product comprises a first type of bacterial spores and a second type of bacterial spores selected from Table 1, or where the first type of bacterial spores and the second type of bacterial spores independently comprise bacterial spores that comprise 16S rDNA sequence at least 95% identical to 16S rDNA sequence present in a bacterium selected from Table 1. In an embodiment, the first purified population, the second purified population and the optional third purified population comprise a combination of bacteria described in any row of Table 4a or Table 4b, a combination of bacteria described in any row of Table 4a that has a ++++ or a +++ designation, or any row of Table 4a that has a $75^{th}$ percentile designation.

Also provided are methods comprising administering to a human subject in need thereof an effective amount of a bacterial composition comprising at least a first type of isolated bacterium, a second type of isolated bacterium and optionally a third type of isolated bacterium, wherein: the first type, second type and optional third type are independently capable of forming a spore; only one of the first type, second type and optional third type is capable of forming a spore; or none of the first type, the second type and optional third type is capable of forming a spore, wherein the first type, second type and optional third type are not identical, and wherein at least one of the first type, second type and optional third type exert an inhibitory-effect on a pathogenic bacterium present in the gastrointestinal tract of the human subject, such that the number of pathogenic bacteria present in the gastrointestinal tract is not detectably increased or is detectably decreased over a period of time. In an embodiment, the composition comprise a combination of bacteria described in any row of Table 4a or Table 4b, a combination of bacteria described in any row of Table 4a that has a ++++ or a +++ designation, or any or of Table 4a that has a 75$^{th}$ percentile designation. In an embodiment, the human subject is diagnosed as having a dysbiosis of the gastrointestinal tract. In an embodiment, the human subject is diagnosed as infected with a pathogenic bacterium selected from the group consisting of *Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus*, multi-drug resistant bacteria, Carbapenem-resistant Enterobacteriaceae (CRE), extended spectrum beta-lactam resistant Enterococci (ESBL), and vancomycin-resistant Enterococci (VRE). In an embodiment, the bacterial composition is administered simultaneously with i) an antibiotic, ii) a prebiotic, or iii) a combination of i) and ii). In an embodiment, the bacterial composition is administered prior to administration of i) an antibiotic, ii) a prebiotic, or iii) a combination of i) and ii). In an embodiment, the bacterial composition is administered subsequent to administration of i) an antibiotic, ii) a prebiotic, or iii) a combination of i) and ii). In an embodiment, the number of pathogenic bacterium present in or excreted from the gastrointestinal tract of the human subject is detectably reduced within one month, within two weeks, or within one week of administration of the bacterial composition. In an embodiment, the number of pathogenic bacterium present in or excreted from the gastrointestinal tract of the human subject is detectably reduced within three days, two days or one day of administration of the bacterial composition. In an embodiment, the human subject is detectably free of the pathogenic bacterium within one month, two weeks, one week, three days or one day of administration of the bacterial composition. In an embodiment, the bacterial composition comprises at least about 3, 4, 5, 6, 7, 8, 9, or 10 types of isolated bacteria. In an embodiment, the bacterial composition comprises at least about 3, 4, 5, 6, 7, 8, 9, or 10 types of isolated bacteria and at least 1, 2, 3, 4, 5, 6, 7, 8, 9, or 10 of the isolated bacteria are capable of forming spores. In an embodiment, the bacterial composition comprises at least about 5 types of isolated bacteria and at least 2 of the isolated bacteria are capable of forming spores. In an embodiment, the bacterial composition comprises: i) at least about 3, 4, 5, 6, 7, 8, 9, 10, 11, 12, 13, 14, 15, 16, 17, 18, 19, 20, 21, 22, 23, 24, 25, 26, 27, 28, 29, 30 or more types of isolated bacteria capable of forming spores, ii) at least about 3, 4, 5, 6, 7, 8, 9, 10, 11, 12, 13, 14, 15, 16, 17, 18, 19, 20, 21, 22, 23, 24, 25, 26, 27, 28, 29, 30 or more types of isolated bacteria not known to be capable of forming spores, or iii) any combination of i) and ii). In an embodiment, the bacterial composition comprises at least about 5 types of isolated bacteria and at least 1 of the isolated bacteria are capable of forming spores. In an embodiment, the bacterial composition comprises at least about 5 types of isolated bacteria and at least 1 of the isolated bacteria is not capable of forming spores. In an embodiment, the bacterial composition comprises at least about 3, 4, 5, 6, 7, 8, 9 or 10 types of isolated bacteria, wherein i) at least 1, 2, 3, 4, 5, 6, 7, 8, 9 or 10 types of isolated bacteria are capable of forming spores, ii) at least 1, 2, 3, 4, 5, 6, 7, 8, 9 or 10 types of isolated bacteria are not capable of forming spores, or iii) any combination of i) and ii). In an embodiment, the first type, second type and optional third type are present in the composition in approximately equal concentrations. In an embodiment, the first type, second type and optional third type are present in the composition in not substantially equal concentrations. In an embodiment, the first type is present in the composition in at least about 150% the concentration of the second type, or wherein the second type is present in the composition in at least about 150% the concentration of the first type. In an embodiment, the composition consists essentially of between two and about ten types of isolated bacteria, wherein at least two types of isolated bacteria are independently capable of spore formation. In an embodiment, the composition consists essentially of between two and about ten types of isolated bacteria, wherein at least two types of isolated bacteria are not capable of spore formation. In an embodiment, the first type of isolated bacterium and the second type of isolated bacterium are selected from Table 1. In an embodiment, the first type of isolated bacterium, the second type of isolated bacterium and the optional third type of isolated bacterium comprise an operational taxonomic unit (OTU) distinction. In an embodiment, the OTU distinction comprises 16S rDNA sequence similarity below about 95% identity. In an embodiment, the first type of isolated bacterium and the second type of isolated bacterium independently comprise bacteria that comprise 16S rDNA sequence at least 95% identical to 16S rDNA sequence present in a bacterium selected from Table 1. In an embodiment, a combination of the first type, second type and optional third type are cytotoxic or cytostatic to the pathogenic bacterium. In an embodiment, the combination is capable of inhibiting proliferation of the pathogenic bacterial present at a concentration at least equal to the concentration of the combination of the first type, second type and optional third type. In an embodiment, the combination is capable of inhibiting proliferation of the pathogenic bacterial present at a concentration at least about twice the concentration of the combination of the first type, second type and optional third type. In an embodiment, the combination is capable of inhibiting proliferation of the pathogenic bacterial present at a concentration at least about ten times the concentration of the combination of the first type, second type and optional third type. In an embodiment, the pathogenic bacterium is selected from the group consisting of *Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus*, multi-drug resistant bacteria, Carbapenem-resistant Enterobacteriaceae (CRE), extended spectrum beta-lactam resistant Enterococci (ESBL), and vancomycin-resistant Enterococci (VRE). In an embodiment, the first type, second type and optional third type synergistically interact to be cytotoxic to the pathogenic bacterium. In an embodiment, the first type, second type and optional third type synergistically interact to be cytostatic to the pathogenic bacterium.

Also provided are methods of functionally populating the gastrointestinal tract of a human subject, comprising administering to the subject an effective amount of a bacterial composition comprising at least a first type of isolated bacterium, a second type of isolated bacterium, and optionally a third type of isolated bacterium wherein i) the first type, second type and optional third type are independently capable of forming a spore; ii) only one of the first type, second type and optional third type is capable of forming a spore or iii) none of the first type, the second type and the optional third type is capable of forming a spore, wherein the first type, second type and optional third type are not identical, under conditions such that the first type, second type and optional third type functionally populate the gastrointestinal tract of the human subject. In an embodiment, the composition comprises a combination of bacteria described in any row of Table 4a or Table 4b, a combination of bacteria described in any row of Table 4a that has a ++++ or a +++ designation, or any row of Table 4a that has a $75^{th}$ percentile designation. In an embodiment, the bacterial composition is orally administered, rectally administered, or the combination of orally and rectally administered. In an embodiment, the bacterial composition is topically or nasally administered or inhaled. In an embodiment, the first type of isolated bacteria and the second type of isolated bacteria are selected from Table 1. In an embodiment, the bacterial composition consists essentially of spores, wherein the spores comprise spores of the first type of isolated bacteria, spores of the second type of isolated bacteria and spores of the optional third type of isolated bacteria. In an embodiment, the first type of isolated bacteria and the second type of isolated bacteria independently comprise bacterial spores that comprise 16S rDNA sequence at least 95% identical to 16S rDNA sequence present in a bacterium selected from Table 1. In an embodiment, the functional populating of the gastrointestinal tract comprises preventing a dysbiosis of the gastrointestinal tract. In an embodiment, the functional populating of the gastrointestinal tract comprises treating a dysbiosis of the gastrointestinal tract. In an embodiment, the functional populating of the gastrointestinal tract comprises reducing the severity of a dysbiosis of the gastrointestinal tract. In an embodiment, the functional populating of the gastrointestinal tract comprises reducing one or more symptoms of a dysbiosis of the gastrointestinal tract. In an embodiment, the functional populating of the gastrointestinal tract comprises preventing colonization of the gastrointestinal tract by a pathogenic bacterium. In an embodiment, the functional populating of the gastrointestinal tract comprises reducing colonization of the gastrointestinal tract and/or growth by a pathogenic bacterium. In an embodiment, wherein the functional populating of the gastrointestinal tract comprises reducing the number of one or more types of pathogenic bacteria in the gastrointestinal tract. In an embodiment, the functional populating of the gastrointestinal tract comprises increasing the number of one or more non-pathogenic bacteria in the gastrointestinal tract. In an embodiment, the bacterial composition comprises at least about 3, 5, 7 or 9 types of isolated bacteria capable of forming spores. In an embodiment, the bacterial composition comprises at least about 5 types of isolated bacteria and at least 20% of the isolated bacteria are capable of forming spores. In an embodiment, the bacterial composition comprises at least about 5 types of isolated bacteria and at least 2 of the isolated bacteria are capable of forming spores. In an embodiment, the bacterial composition comprises at least about 3, 4, 5, 6, 7, 8, 9 or 10 types of isolated bacteria, wherein i) at least 1, 2, 3, 4, 5, 6, 7, 8, 9 or 10 types of isolated bacteria are capable of forming spores, ii) at least 1, 2, 3, 4, 5, 6, 7, 8, 9 or 10 types of isolated bacteria are not capable of forming spores, or iii) any combination of i) and ii). In an embodiment, the first type, second type and optional third type are present in the composition in approximately equal concentrations. In an embodiment, the first type, second type and optional third type are present in the composition in not substantially equal concentrations. In an embodiment, the first type is present in the composition in at least about 150% the concentration of the second type, or wherein the second type is present in the composition in at least about 150% the concentration of the first type. In an embodiment, the composition consists essentially of between two and about ten types of isolated bacteria, wherein i) at least one type of isolated bacteria is capable of spore formation, ii) at least one type of isolated bacteria is not capable of spore formation, or iii) a combination of i) and ii). In an embodiment, a combination of the first type, second type and optional third type are inhibitory to the pathogenic bacterium. In an embodiment, the combination reduces the growth rate of the pathogenic bacterium. In an embodiment, the combination is cytostatic or cytotoxic to the pathogenic bacterium. In an embodiment, the combination is capable of inhibiting growth of the pathogenic bacterial present at a concentration at least equal to the concentration of the combination of the first type, second type and optional third type. In an embodiment, the combination is capable of inhibiting growth of the pathogenic bacterial present at a concentration at least about twice the concentration of the combination of the first type, second type and optional third type. In an embodiment, the combination is capable of inhibiting proliferation of the pathogenic bacterial present at a concentration at least about ten times the concentration of the combination of the first type, second type and optional third type. In an embodiment, the pathogenic bacterium is selected from the group consisting of *Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus*, multi-drug resistant bacteria, Carbapenem-resistant Enterobacteriaceae (CRE), extended spectrum beta-lactam resistant Enterococci (ESBL), and vancomycin-resistant Enterococci (VRE). In an embodiment, the first type, second type and optional third type synergistically interact to reduce or inhibit the growth of the pathogenic bacterium. In an embodiment, the first type, second type and optional third type synergistically interact to reduce or inhibit the colonization of the pathogenic bacterium. In an embodiment, the method comprises administering to the human subject a single dose unit comprising at least $1\times10^4$, $1\times10^5$, $1\times10^6$, $1\times10^7$, $1\times10^8$, $1\times10^9$, $1\times10^{10}$, $1\times10^{11}$ or greater than $1\times10^{11}$ colony forming units (CFUs) of viable bacteria. In an embodiment, the dose unit comprises a bacterial population substantially in the form of spores. In an embodiment, the dose unit comprises a pharmaceutically acceptable excipient and/or an enteric coating. In an embodiment, the unit dose is formulated for oral administration, rectal administration, or the combination of oral and rectal administration. In an embodiment, the unit dose is formulated for topical or nasal administration or for inhalation.

In another aspect, provided are methods of reducing the number of pathogenic bacteria present in the gastrointestinal tract of a human subject, comprising administering to the subject an effective amount of a pharmaceutical formulation comprising an effective amount of the composition of any one of claims 1, 21, 22 or 31, and further comprising an effective amount of an anti-microbial agent, under conditions such that the number of pathogenic bacteria present in the gastrointestinal tract of the human subject is reduced within about one month of administration of the pharmaceutical formulation. In an embodiment, the number of pathogenic bacteria present in the gastrointestinal tract of the human subject is reduced within about two weeks of administration of the pharmaceutical formulation. In an embodiment, the number of pathogenic bacteria present in the gastrointestinal tract of the human subject is reduced within about one week of administration of the pharmaceutical formulation. In an embodiment, the number of pathogenic bacteria present in the gastrointestinal tract of the human subject is reduced within about three days of administration of the pharmaceutical formulation. In an embodiment, the number of pathogenic bacteria present in the gastrointestinal tract of the human subject is reduced within about one day of administration of the pharmaceutical formulation. In an embodiment, the anti-microbial agent comprises anti-bacterial agent. In an embodiment, the anti-microbial agent comprises anti-fungal agent. In an embodiment, the anti-microbial agent comprises anti-viral agent. In an embodiment, the anti-microbial agent comprises anti-parasitic agent.

In another aspect, provided are methods of preparing a comestible product, comprising combining with a comestible carrier a first purified population comprising at least a first type of isolated bacterium, a second purified population comprising at least a second type of isolated bacterium and optionally a third purified population comprising at least a third type of isolated bacterium, wherein: i) the first type, second type and optional third type are independently capable of forming a spore; ii) only one of the first type, second type and optional third type is capable of forming a spore or iii) none of the first type, the second type and the optional third type is capable of forming a spore, wherein the first type, second type and optional third type of bacteria are not identical, wherein the comestible product is substantially free of non-comestible materials. In an embodiment, at least one of the first purified population, the second purified population and the optional third purified population consist essentially of viable spores. In an embodiment, the first purified population, the second purified population and the optional third purified population consist essentially of viable spores. In an embodiment, the comestible product is substantially free of viable vegetal bacterial cells. In an embodiment, the viable spores, when the comestible product is consumed by a human subject in need thereof, are capable of functionally populating the gastrointestinal tract of the human subject. In an embodiment, the comestible product comprises a food or food additive. In an embodiment, the comestible product comprises a beverage or beverage additive. In an embodiment, the comestible product comprises a medical food. In an embodiment, the comestible product comprises at least $1\times10^4$, $1\times10^5$, $1\times10^6$, $1\times10^7$, $1\times10^8$, $1\times10^9$, $1\times10^{10}$, $1\times10^{11}$ or greater than $1\times10^{11}$ colony forming units (CFUs) of viable spores. In an embodiment, the first purified population, the second purified population and the optional third purified population comprise a combination of bacteria described in any row of Table 4a or Table 4b, or any row of Table 4a that has a ++++ designation or a +++ designation, or any row of Table 4a that has a $75^{th}$ percentile designation. In an embodiment, spores are of a bacterium selected from Table 1. In an embodiment, the first purified population and the second purified population independently comprise bacterial spores that comprise 16S rDNA sequence at least 95% identical to 16S rDNA sequence present in a bacterium selected from Table 1.

Also provided are methods of reducing the abundance of a pathogen in the gastrointestinal tract of a subject comprising administering a composition of in a therapeutically effective amount and allowing the bacterial composition to compete with the pathogen in the gastrointestinal tract of a subject.

Further provided are methods of treating diarrhea comprising administering a bacterial composition in a therapeutically effective amount and allowing the bacterial composition to reduce the diarrheal effect of a pathogen in the gastrointestinal tract of a subject. In an embodiment, the pathogen is *Yersinia, Vibrio, Treponema, Streptococcus, Staphylococcus, Shigella, Salmonella, Rickettsia, Orientia, Pseudomonas, Providencia, Proteus, Propionibacterium, Neisseria, Mycoplasma, Mycobacterium, Morganella, Listeria, Leptospira, Legionella, Klebsiella, Helicobacter, Haemophilus, Fusobacterium, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus*, multi-drug resistant bacteria, Carbapenem-resistant Enterobacteriaceae (CRE), extended spectrum beta-lactam resistant Enterococci (ESBL), and vancomycin-resistant Enterococci (VRE). In an embodiment, the pathogen is *Clostridium difficile, Salmonella* spp., pathogenic *Escherichia coli*, or vancomycin-resistant *Enterococcus* spp. In an embodiment, the pathogen is *Clostridium difficile*. In an embodiment, the composition is administered orally. In an embodiment the composition comprises a combination of bacteria described in any row of Table 4a, or Table 4b, or any row of Table 4a that has a ++++ designation or a +++ designation, or any row of Table 4a that has a $75^{th}$ percentile designation.

In some aspects, the invention relates to a composition comprising a network ecology selected from Table 10. In some embodiments, the network ecology comprises network clades provided in Table 10. In other embodiments, the network ecology comprises network OTUs provided in Table 10. In some cases the composition comprises *Blautia producta, Clostridium disporicum, Clostridium innocuum, Clostridium mayombei, Clostridium orbiscindens, Clostridium symbiosum*, and Lachnospiraceae bacterium 5_1_57FAA. In some embodiments, the composition the composition is effective for treating at least one sign or symptom of a dysbiosis, for example, the is effective for reducing at least one sign or symptom of infection or dysbiosis associated with *C. difficile, Klebsiella pneumonii, Morganella morganii*, or vancomycin-resistant Enterococci (VRE).

In another aspect, the invention relates to a composition comprising a bacterial heterotrimer selected from a heterotrimer identified in Table 4a, Table 4b, or Table 12, such that the heterotrimer can e.g., inhibit growth of a pathobiont in a CivSim assay.

In some aspects, the invention relates to a composition comprising a bacterial heterotrimer selected from a heterotrimer identified in Table 14, Table 15, Table 16, Table 17, Table 17, Table 18, Table 19, Table 20, or Table 21, such that the organisms of the heterotrimer can augment and/or engraft in a human gastrointestinal tract. In some embodiments, the engraftment and/or augmentation can occur after administration of the composition to a human having a dysbiosis. In some embodiments, the dysbiosis is associated with the presence of C. difficile in the gastrointestinal tract of the human.

Additional objects and advantages will be set forth in part in the description which follows, and in part will be obvious from the description, or may be learned by practice of the embodiments. The objects and advantages will be realized and attained by means of the elements and combinations particularly pointed out in the appended claims.

It is to be understood that both the foregoing general description and the following detailed description are exemplary and explanatory only and are not restrictive of the claims.

The accompanying drawings, which are incorporated in and constitute a part of this specification, illustrate several embodiments and together with the description, serve to further explain the embodiments.

BRIEF DESCRIPTION OF TABLES

Table 1 is a list of Operational Taxonomic Units (OTU) with taxonomic assignments made to genus, species, and phylogenetic clade. Clade membership of bacterial OTUs is based on 16S sequence data. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are: (i) within a specified number of bootstrap supported nodes from one another, and (ii) within 5% genetic similarity. OTUs that are within the same clade can be distinguished as genetically and phylogenetically distinct from OTUs in a different clade based on 16S-V4 sequence data, while OTUs falling within the same clade are closely related. OTUs falling within the same clade are evolutionarily closely related and may or may not be distinguishable from one another using 16S-V4 sequence data. Members of the same clade, due to their evolutionary relatedness, play similar functional roles in a microbial ecology such as that found in the human gut. Compositions substituting one species with another from the same clade are likely to have conserved ecological function and therefore are useful in the present invention. All OTUs are denoted as to their putative capacity to form spores and whether they are a pathogen or pathobiont (see Definitions for description of "Pathobiont"). NIAID (National Institute of Allergy and Infectious Disease) Priority Pathogens are denoted as 'Category-A', 'Category-B', or 'Category-C', and opportunistic pathogens are denoted as 'OP'. OTUs that are not pathogenic or for which their ability to exist as a pathogen is unknown are denoted as 'N'. The 'SEQ ID Number' denotes the identifier of the OTU in the Sequence Listing File and 'Public DB Accession' denotes the identifier of the OTU in a public sequence repository.

Table 2 provides phylogenetic clades and their members determined using 16S full-length and V4 sequencing.

Table 3 is a list of human diseases, disorders and conditions for which the provided bacterial compositions are useful.

Table 4a. Provides representative combinations of the present invention tested in vitro.

Table 4b. Provides representative combinations of the present invention tested in vitro Table 5 provides data from testing of representative ternary OTU combinations of the present invention in a CivSim assay and in vivo.

Table 6 provides data on the ability of a 15 member bacterial composition to inhibit VRE in vitro.

Table 7 provides data on the ability of a 15 member bacterial composition to inhibit K. pneumoniae in vitro.

Table 8 provides data on the ability of a 15 member bacterial composition to inhibit M. morganii in vitro.

Table 9 provides data demonstrating the efficacy of combinations of the present invention against C. difficile infection in a preventive murine model.

Table 10. Provides exemplary combinations of the present invention that were tested against C. difficile infection in a preventive murine model.

Table 11. Provides bacterial OTUs associated with a bacterial composition used to treat patients with C. difficile associated diarrheal disease, and to OTUs comprising the OTUs undergo engraftment and ecological augmentation to establish a more diverse microbial ecology in patients post-treatment. OTUs that comprise an augmented ecology are not present in the patient prior to treatment and/or exist at extremely low frequencies such that they do not comprise a significant fraction of the total microbial carriage and are not detectable by genomic and/or microbiological assay methods. OTUs that are members of the engrafting and augmented ecologies were identified by characterizing the OTUs that increase in their relative abundance post treatment and that respectively are: (i) present in the ethanol-treated spore preparation and absent in the patient pretreatment, or (ii) absent in the ethanol-treated spore preparation, but increase in their relative abundance through time post treatment with the preparation due to the formation of favorable growth conditions by the treatment. Notably, augmenting OTUs can grow from low frequency reservoirs in the subject, or be introduced from exogenous sources such as diet. OTUs that comprise a "core" composition in the treatment bacterial composition are denoted.

Table 12 provides bacterial compositions that exhibited inhibition against C. difficile as measured by a mean log inhibition greater than the 99% confidence interval (C.I.) of the null hypothesis (see Example 6, ++++) and that are identified in at least one spore ecology treatment or in a human subject microbiome after treatment with a composition.

Table 13 provides exemplary of 4-mer to 10-mer bacterial compositions that were comprised in a bacterial therapy administered to subjects with C. difficile-associated diarrheal disease.

Table 14 provides exemplary ternary OTUs that either engrafted or augmented in at least one patient (of 29 that responded to treatment) after treatment with a spore ecology composition. Each ternary combination was either in all doses or the organisms of the ternary combination were present together in all subjects at some post-treatment time.

Table 15 provides exemplary OTUs that engrafted in at least one subject. The ternary combinations were found in 95% of the doses of administered spore ecology compositions.

Table 16 provides exemplary OTUs that augmented in at least one patient post treatment with a spore ecology composition. The ternary combinations were found together in at least 75% of the subjects at some post-treatment timepoint.

Table 17 provides exemplary OTU combinations that were present in at least 75% of the doses of administered spore ecology compositions. All administered doses containing the listed ternary combinations had the OTU Clostridiales sp. SM4/1 as either augmenting or engrafting in the subjects given doses containing the ternary composition.

Table 18 provides exemplary ternary OTU combinations that were present in at least 75% of the doses of administered spore ecology compositions. All administered doses containing the listed ternary combinations had the OTU *Clostridiales* sp. SSC/2 as either augmenting or engrafting in the subjects given a composition containing the ternary combination.

Table 19 provides exemplary ternary combinations of OTUs that were present in at least 75% of the doses of administered spore ecology compositions. All administered doses containing the listed ternary combinations had the OTU *Clostridium* sp. NML 04A032 as either augmenting or engrafting in the subjects given a composition containing the ternary combination.

Table 20 provides exemplary ternary combinations of OTUs that were present in at least 75% of the doses of administered spore ecology compositions. All administered doses containing the listed ternary combinations had the OTUs *Clostridium* sp. NML 04A032, *Ruminococcus lactaris*, and *Ruminococcus torques* as either augmenting or engrafting in the subjects given a composition containing the ternary combination.

Table 21 provides exemplary ternary combinations of OTUs that are present in at least 75% of the doses of administered spore ecology compositions. All administered doses containing the listed ternary combinations had the OTUs *Eubacterium rectale*, *Faecalibacterium prausnitzii*, *Oscillibacter* sp. G2, *Ruminococcus lactaris*, and *Ruminococcus torques* as either augmenting or engrafting in the subjects given a composition containing the ternary combination.

Table 22 provides alternate names of organisms found in OTUs of the embodiments of the present invention.

BRIEF DESCRIPTION OF FIGURES

FIG. 3 highlights in bold the nucleotide sequences for each hypervariable region in the exemplary reference *E. coli* 16S sequence (SEQ ID NO: 2047) described by Brosius et al., supra.

FIG. 4 provides representative combinations of the present invention tested in vitro and their respective inhibition of pathogen growth.

DEFINITIONS

Figure 1:
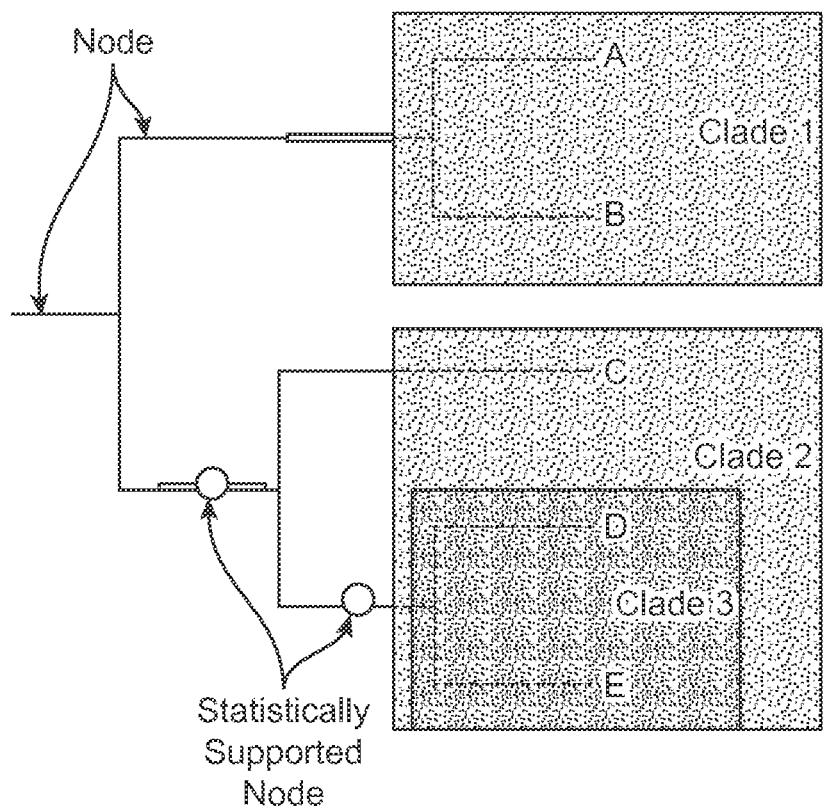
FIG. 1 shows an exemplary phylogenetic tree and the relationship of OTUs and Clades. A, B, C, D, and E represent OTUs, also known as leaves in the tree. Clade 1 comprises OTUs A and B, Clade 2 comprises OTUs C, D and E, and Clade 3 is a subset of Clade 2 comprising OTUs D and E. Nodes in a tree that define clades in the tree can be either statistically supported or not statistically supported. OTUs within a clade are more similar to each other than to OTUs in another clade; the robustness the clade assignment is denoted by the degree of statistical support for a node upstream of the OTUs in the clade.

As used herein, the term "antioxidant" refers to, without limitation, any one or more of various substances such as beta-carotene (a vitamin A precursor), vitamin C, vitamin E, and selenium that inhibit oxidation or reactions promoted by Reactive Oxygen Species ("ROS") and other radical and non-radical species. Additionally, antioxidants are molecules capable of slowing or preventing the oxidation of other molecules. Non-limiting examples of antioxidants include astaxanthin, carotenoids, coenzyme Q10 ("CoQ10"), flavonoids, glutathione, Goji (wolfberry), hesperidin, lactowolfberry, lignan, lutein, lycopene, polyphenols, selenium, vitamin A, vitamin C, vitamin E, zeaxanthin, or combinations thereof.

"Backbone Network Ecology" or simply "Backbone Network" or "Backbone" are compositions of microbes that form a foundational composition that can be built upon or subtracted from to optimize a Network Ecology or Functional Network Ecology to have specific biological characteristics or to comprise desired functional properties, respectively. Microbiome therapeutics can be comprised of these "Backbone Networks Ecologies" in their entirety, or the "Backbone Networks" can be modified by the addition or subtraction of "R-Groups" to give the network ecology desired characteristics and properties. "R-Groups" as used herein, can be defined in multiple terms including, but not limited to: individual OTUs, individual or multiple OTUs derived from a specific phylogenetic clade or a desired phenotype such as the ability to form spores, or functional bacterial compositions that comprise. "Backbone Networks" can comprise a computationally derived Network Ecology in its entirety or can be subsets of the computed network that represent key nodes in the network that contributed to efficacy such as but not limited to a composition of Keystone OTUs. The number of organisms in the human gastrointestinal tract, as well as the diversity between healthy individuals, is indicative of the functional redundancy of a healthy gut microbiome ecology. See The Human Microbiome Consortia. 2012. Structure, function and diversity of the healthy human microbiome. Nature 486: 207-214. This redundancy makes it highly likely that non-obvious subsets of OTUs or functional pathways (i.e., "Backbone Networks") are critical to maintaining states of health and or catalyzing a shift from a dysbiotic state to one of health. One way of exploiting this redundancy is through the substitution of OTUs that share a given clade (see below) or of adding members of a clade not found in the Backbone Network.

"Bacterial Composition" refers to a consortium of microbes comprising two or more OTUs. Backbone Network Ecologies, Functional Network Ecologies, Network Classes, and Core Ecologies are all types of bacterial compositions. A "Bacterial Composition" can also refer to a composition of enzymes that are derived from a microbe or multiple microbes. As used herein, Bacterial Composition includes a therapeutic microbial composition, a prophylactic microbial composition, a Spore Population, a Purified Spore Population, or ethanol treated spore population.

"Clade" refers to the OTUs or members of a phylogenetic tree that are downstream of a statistically valid node in a phylogenetic tree (FIG. 1). The clade comprises a set of terminal leaves in the phylogenetic tree (i.e., tips of the tree) that are a distinct monophyletic evolutionary unit and that share some extent of sequence similarity. Clades are hierarchical. In one embodiment, the node in a phylogenetic tree that is selected to define a clade is dependent on the level of resolution suitable for the underlying data used to compute the tree topology. Exemplary clades are delineated in Table 1 and Table 2. As used herein, clade membership of bacterial OTUs is based on 16S sequence data. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are (i) within a specified number of bootstrap supported nodes from one another, and (ii) within 5% genetic identity. OTUs that are within the same clade can be distinguished as genetically and phylogenetically distinct from OTUs in a different clade based on 16S-V4 sequence data, while OTUs falling within the same clade are closely related. OTUs falling within the same clade are evolutionarily closely related and may or may not be distinguishable from one another using 16S-V4 sequence data. Members of the same clade, due to their evolutionary relatedness, play or are predicted to play similar functional roles in a microbial ecology such as that found in the human gut. In some embodiments, one OTU from a clade can be substituted in a composition by a different OTU from the same clade.

The "Colonization" of a host organism includes the non-transitory residence of a bacterium or other microscopic organism. As used herein, "reducing colonization" of a host subject's gastrointestinal tract (or any other microbiotal niche) by a pathogenic or non-pathogenic bacterium includes a reduction in the residence time of the bacterium the gastrointestinal tract as well as a reduction in the number (or concentration) of the bacterium in the gastrointestinal tract or adhered to the luminal surface of the gastrointestinal tract. The reduction in colonization can be permanent or occur during a transient period of time. Reductions of adherent pathogens can be demonstrated directly, e.g., by determining pathogenic burden in a biopsy sample, or reductions may be measured indirectly, e.g., by measuring the pathogenic burden in the stool of a mammalian host.

A "Combination" of two or more bacteria includes the physical co-existence of the two bacteria, either in the same material or product or in physically connected products, as well as the temporal co-administration or co-localization of the two bacteria.

The term "consisting essentially of" as used herein conforms to the definition as provided in the Manual of Patent Examination and Procedure (MPEP; March 2014). The basic and novel characteristics of inventions claimed herein include the ability to catalyze changes in a microbiome ecology of a mammalian subject, e.g., a human, from dysbiotic to a more normative state, and to promote engraftment and augmentation of microbiome component as set out in the specification, e.g., see Tables 14-21. A more normative state can include, in a non-limiting example, a decrease in a sign or symptom of a disease or disorder associated with a dysbiosis.

"Cytotoxic" activity of bacterium includes the ability to kill a bacterial cell, such as a pathogenic bacterial cell. A "cytostatic" activity or bacterium includes the ability to inhibit, partially or fully, growth, metabolism, and/or proliferation of a bacterial cell, such as a pathogenic bacterial cell. Cytotoxic activity may also apply to other cell types such as but not limited to Eukaryotic cells.

"Dimer" refers to a combination of bacteria that is comprised of two OTUs. The descriptions "homodimer" and "heterodimer" refer to combinations where the two OTUs are the same or different, respectively.

"Dysbiosis" refers to a state of the microbiota or microbiome of the gut or other body area, including mucosal or skin surfaces in which the normal diversity and/or function of the ecological network is disrupted. Any disruption from a preferred (e.g., ideal) state of the microbiota can be considered a dysbiosis, even if such dysbiosis does not result in a detectable decrease in health. This state of dysbiosis may be unhealthy, it may be unhealthy under only certain conditions, or it may prevent a subject from becoming healthier. Dysbiosis may be due to a decrease in diversity, the overgrowth of one or more pathogens or pathobionts, symbiotic organisms able to cause disease only when certain genetic and/or environmental conditions are present in a subject, or the shift to an ecological network that no longer provides a beneficial function to the host and therefore no longer promotes health.

"Ecological Niche" or simply "Niche" refers to the ecological space in which an organism or group of organisms occupies. Niche describes how an organism or population or organisms responds to the distribution of resources, physical parameters (e.g., host tissue space) and competitors (e.g., by growing when resources are abundant, and when predators, parasites and pathogens are scarce) and how it in turn alters those same factors (e.g., limiting access to resources by other organisms, acting as a food source for predators and a consumer of prey).

"Germinant" is a material or composition or physical-chemical process capable of inducing vegetative growth of a bacterium that is in a dormant spore form, or group of bacteria in the spore form, either directly or indirectly in a host organism and/or in vitro.

"Inhibition" of a pathogen or non-pathogen encompasses the inhibition of any desired function or activity of the bacterial compositions of the present invention. Demonstrations of inhibition, such as decrease in the growth of a pathogenic bacterium or reduction in the level of colonization of a pathogenic bacterium are provided herein and otherwise recognized by one of ordinary skill in the art. Inhibition of a pathogenic or non-pathogenic bacterium's "growth" may include inhibiting the increase in size of the pathogenic or non-pathogenic bacterium and/or inhibiting the proliferation (or multiplication) of the pathogenic or non-pathogenic bacterium. Inhibition of colonization of a pathogenic or non-pathogenic bacterium may be demonstrated by measuring the amount or burden of a pathogen before and after a treatment. An "inhibition" or the act of "inhibiting" includes the total cessation and partial reduction of one or more activities of a pathogen, such as growth, proliferation, colonization, and function. Inhibition of function includes, for example, the inhibition of expression of pathogenic gene products such as a toxin or invasive pilus induced by the bacterial composition.

"Isolated" encompasses a bacterium or other entity or substance that has been (1) separated from at least some of the components with which it was associated when initially produced (whether in nature or in an experimental setting), and/or (2) produced, prepared, purified, and/or manufactured by the hand of man. Isolated bacteria include those bacteria that are cultured, even if such cultures are not monocultures. Isolated bacteria may be separated from at least about 10%, about 20%, about 30%, about 40%, about 50%, about 60%, about 70%, about 80%, about 90%, or more of the other components with which they were initially associated. In some embodiments, isolated bacteria are more than about 80%, about 85%, about 90%, about 91%, about 92%, about 93%, about 94%, about 95%, about 96%, about 97%, about 98%, about 99%, or more than about 99% pure. In some embodiments, isolated bacteria are separated from 10%, 20%, 30%, 40%, 50%, 60%, 70%, 80%, 90%, or more of the other components with which they were initially associated. In some embodiments, isolated bacteria are more than 80%, 85%, 90%, 91%, 92%, 93%, 94%, 95%, 96%, 97%, 98%, 99%, or more than 99% pure. As used herein, a substance is "pure" if it is substantially free of other components. The terms "purify," "purifying" and "purified" refer to a bacterium or other material that has been separated from at least some of the components with which it was associated either when initially produced or generated (e.g., whether in nature or in an experimental setting), or during any time after its initial production. A bacterium or a bacterial population may be considered purified if it is isolated at or after production, such as from a material or environment containing the bacterium or bacterial population, or by passage through culture, and a purified bacterium or bacterial population may contain other materials up to about 10%, about 20%, about 30%, about 40%, about 50%, about 60%, about 70%, about 80%, about 90%, or above about 90% and still be considered "isolated." In other embodiments, a purified bacterium or bacterial population may contain other materials up to 10%, 20%, 30%, 40%, 50%, 60%, 70%, 80%, 90%, or 90% and still be considered "isolated." In some embodiments, purified bacteria and bacterial populations are more than about 80%, about 85%, about 90%, about 91%, about 92%, about 93%, about 94%, about 95%, about 96%, about 97%, about 98%, about 99%, or more than about 99% pure. In some embodiments, purified bacteria and bacterial populations are more than 80%, 85%, 90%, 91%, 92%, 93%, 94%, 95%, 96%, 97%, 98%, 99%, or more than 99% pure. In the instance of bacterial compositions provided herein, the one or more bacterial types present in the composition can be independently purified from one or more other bacteria produced and/or present in the material or environment containing the bacterial type. Bacterial compositions and the bacterial components thereof are generally purified from residual habitat products.

"Keystone OTU" or "Keystone Function" refers to one or more OTUs or Functional Pathways (e.g., KEGG or COG pathways) that are common to many network ecologies or functional network ecologies and are members of networks that occur in many subjects (i.e., are pervasive). Due to the ubiquitous nature of Keystone OTUs and their associated Functions Pathways, they are central to the function of network ecologies in healthy subjects and are often missing or at reduced levels in subjects with disease. Keystone OTUs and their associated functions may exist in low, moderate, or high abundance in subjects. "Non-Keystone OTU" or "non-Keystone Function" refers to an OTU or Function that is observed in a Network Ecology or a Functional Network Ecology and is not a keystone OTU or Function.

"Microbiota" refers to the community of microorganisms that occur (sustainably or transiently) in and on an animal subject, typically a mammal such as a human, including eukaryotes, archaea, bacteria, and viruses (including bacterial viruses, i.e., phage).

"Microbiome" refers to the genetic content of the communities of microbes that live in and on the human body, both sustainably and transiently, including eukaryotes, archaea, bacteria, and viruses (including bacterial viruses (i.e., phage)), wherein "genetic content" includes genomic DNA, RNA such as ribosomal RNA, the epigenome, plasmids, and all other types of genetic information.

"Microbial Carriage" or simply "Carriage" refers to the population of microbes inhabiting a niche within or on humans. Carriage is often defined in terms of relative abundance. For example, OTU 1 comprises 60% of the total microbial carriage, meaning that OTU 1 has a relative abundance of 60% compared to the other OTUs in the sample from which the measurement was made. Carriage is most often based on genomic sequencing data where the relative abundance or carriage of a single OTU or group of OTUs is defined by the number of sequencing reads that are assigned to that OTU/s relative to the total number of sequencing reads for the sample. Alternatively. Carriage may be measured using microbiological assays.

"Microbial Augmentation" or simply "augmentation" refers to the establishment or significant increase of a population of microbes that are (i) absent or undetectable (as determined by the use of standard genomic and microbiological techniques) from the administered therapeutic microbial composition, (ii) absent, undetectable, or present at low frequencies in the host niche (for example: gastrointestinal tract, skin, anterior-nares, or vagina) before the delivery of the microbial composition, and (iii) are found after the administration of the microbial composition or significantly increased, for example, 2-fold, 5-fold, $1\times10^2$, $1\times10^3$, $1\times10^4$, $1\times10^5$, $1\times10^6$, $1\times10^7$, or greater than $1\times10^8$, in cases where they were present at low frequencies. The microbes that comprise an augmented ecology can be derived from exogenous sources such as food and the environment, or grow out from micro-niches within the host where they reside at low frequency. The administration of a bacterial microbial composition induces an environmental shift in the target niche that promotes favorable conditions for the growth of these commensal microbes. In the absence of treatment with a bacterial composition, the host can be constantly exposed to these microbes; however, sustained growth and the positive health effects associated with the stable population of increased levels of the microbes comprising the augmented ecology are not observed.

"Microbial Engraftment" or simply "engraftment" refers to the establishment of OTUs present in the bacterial composition in a target niche that are absent in the treated host prior to treatment. The microbes that comprise the engrafted ecology are found in the therapeutic microbial composition and establish as constituents of the host microbial ecology upon treatment. Engrafted OTUs can establish for a transient period of time, or demonstrate long-term stability in the microbial ecology that populates the host post treatment with a bacterial composition. The engrafted ecology can induce an environmental shift in the target niche that promotes favorable conditions for the growth of commensal microbes capable of catalyzing a shift from a dysbiotic ecology to one representative of a health state.

As used herein, the term "Minerals" is understood to include boron, calcium, chromium, copper, iodine, iron, magnesium, manganese, molybdenum, nickel, phosphorus, potassium, selenium, silicon, tin, vanadium, zinc, or combinations thereof.

"Network Ecology" refers to a consortium of clades or OTUs that co-occur in some number of subjects. As used herein, a "network" is defined mathematically by a graph delineating how specific nodes (i.e., clades or OTUs) and edges (connections between specific clades or OTUs) relate to one another to define the structural ecology of a consortium of clades or OTUs. Any given Network Ecology will possess inherent phylogenetic diversity and functional properties. A Network Ecology can also be defined in terms of its functional capabilities where for example the nodes would be comprised of elements such as, but not limited to, enzymes, clusters of orthologous groups (COGS; http://www.ncbi.nlm.nih.gov:books/NBK21090/), or KEGG Orthology Pathways (www.genome.jp/kegg/); these networks are referred to as a "Functional Network Ecology". Functional Network Ecologies can be reduced to practice by defining the group of OTUs that together comprise the functions defined by the Functional Network Ecology.

"Network Class" and "Network Class Ecology" refer to a group of network ecologies that in general are computationally determined to comprise ecologies with similar phylogenetic and/or functional characteristics. A Network Class therefore contains important biological features, defined either phylogenetically or functionally, of a group (i.e., a cluster) of related network ecologies. One representation of a Network Class Ecology is a designed consortium of microbes, typically non-pathogenic bacteria, that represents core features of a set of phylogenetically or functionally related network ecologies seen in many different subjects. In some occurrences, a Network Class, while designed as described herein, exists as a Network Ecology observed in one or more subjects. Network Class ecologies are useful for reversing or reducing a dysbiosis in subjects where the underlying, related Network Ecology has been disrupted.

To be free of "non-comestible products" means that a bacterial composition or other material provided herein does not have a substantial amount of a non-comestible product, e.g., a product or material that is inedible, harmful or otherwise undesired in a product suitable for administration, e.g., oral administration, to a human subject. Non-comestible products are often found in preparations of bacteria from the prior art.

"Operational taxonomic units" and "OTU" (or plural, "OTUs") refer to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S sequence or a portion of the 16S sequence. In other embodiments, the entire genomes of two entities are sequenced and compared. In another embodiment, select regions such as multilocus sequence tags (MLST), specific genes, or sets of genes may be genetically compared. In 16S embodiments, OTUs that share ≥97% average nucleotide identity across the entire 16S or some variable region of the 16S are considered the same OTU. See e.g., Claesson et al., 2010. Comparison of two next-generation sequencing technologies for resolving highly complex microbiota composition using tandem variable 16S rRNA gene regions. Nucleic Acids Res 38: e200. Konstantinidis et al., 2006. The bacterial species definition in the genomic era. Philos Trans R Soc Lond B Biol Sci 361: 1929-1940. In embodiments involving the complete genome, MLSTs, specific genes, other than 16S, or sets of genes OTUs that share ≥95% average nucleotide identity are considered the same OTU. See e.g., Achtman and Wagner. 2008. Microbial diversity and the genetic nature of microbial species. Nat. Rev. Microbiol. 6: 431-440; Konstantinidis et al., 2006, supra. The bacterial species definition in the genomic era. Philos Trans R Soc Lond B Biol Sci 361: 1929-1940. OTUs can be defined by comparing sequences between organisms. Generally, sequences with less than 95% sequence identity are not considered to form part of the same OTU. OTUs may also be characterized by any combination of nucleotide markers or genes, in particular highly conserved genes (e.g., "house-keeping" genes), or a combination thereof. Such characterization employs, e.g., WGS data or a whole genome sequence. As used herein, a "type" of bacterium refers to an OTU that can be at the level of a strain, species, clade, or family.

Table 1 below shows a List of Operational Taxonomic Units (OTU) with taxonomic assignments made to genus, species, and phylogenetic clade. Clade membership of bacterial OTUs is based on 16S sequence data. Clades are defined based on the topology of a phylogenetic tree that is constructed from full-length 16S sequences using maximum likelihood methods familiar to individuals with ordinary skill in the art of phylogenetics. Clades are constructed to ensure that all OTUs in a given clade are: (i) within a specified number of bootstrap supported nodes from one another, and (ii) within 5% genetic similarity. OTUs that are within the same clade can be distinguished as genetically and phylogenetically distinct from OTUs in a different clade based on 16S-V4 sequence data, while OTUs falling within the same clade are closely related. OTUs falling within the same clade are evolutionarily closely related and may or may not be distinguishable from one another using 16S-V4 sequence data. Members of the same clade, due to their evolutionary relatedness, play similar functional roles in a microbial ecology such as that found in the human gut. Compositions substituting one species with another from the same clade are likely to have conserved ecological function and therefore are useful in the present invention. All OTUs are denoted as to their putative capacity to form spores and whether they are a Pathogen or Pathobiont (see Definitions for description of "pathobiont"). NIAID Priority Pathogens are denoted as 'Category-A', 'Category-B', or 'Category-C', and Opportunistic Pathogens are denoted as 'OP'. OTUs that are not pathogenic or for which their ability to exist as a pathogen is unknown are denoted as 'N'. The 'SEQ ID Number' denotes the identifier of the OTU in the Sequence Listing File and 'Public DB Accession' denotes the identifier of the OTU in a public sequence repository.

"Pathobionts" or "opportunistic pathogens" refers to specific bacterial species found in healthy hosts that may trigger immune-mediated pathology and/or disease in response to certain genetic or environmental factors (Chow et al., 2011. Curr Op Immunol. Pathobionts of the intestinal microbiota and inflammatory disease. 23: 473-80). A pathobiont is an opportunistic microbe that is mechanistically distinct from an acquired infectious organism. The term "pathogen" as used herein includes both acquired infectious organisms and pathobionts.

"Pathogen," "pathobiont" and "pathogenic" in reference to a bacterium or any other organism or entity that includes any such organism or entity that is capable of causing or affecting a disease, disorder or condition of a host organism containing the organism or entity, including but not limited to pre-diabetes, type 1 diabetes or type 2 diabetes.

"Phenotype" refers to a set of observable characteristics of an individual entity. As example an individual subject may have a phenotype of "health" or "disease". Phenotypes describe the state of an entity and all entities within a phenotype share the same set of characteristics that describe the phenotype. The phenotype of an individual results in part, or in whole, from the interaction of the entity's genome and/or microbiome with the environment, especially including diet.

"Phylogenetic Diversity" is a biological characteristic that refers to the biodiversity present in a given Network Ecology or Network Class Ecology based on the OTUs that comprise the network. Phylogenetic diversity is a relative term, meaning that a Network Ecology or Network Class that is comparatively more phylogenetically diverse than another network contains a greater number of unique species, genera, and taxonomic families. Uniqueness of a species, genera, or taxonomic family is generally defined using a phylogenetic tree that represents the genetic diversity all species, genera, or taxonomic families relative to one another. In another embodiment phylogenetic diversity may be measured using the total branch length or average branch length of a phylogenetic tree. Phylogenetic Diversity may be optimized in a bacterial composition by including a wide range of biodiversity.

"Phylogenetic tree" refers to a graphical representation of the evolutionary relationships of one genetic sequence to another that is generated using a defined set of phylogenetic reconstruction algorithms (e.g., parsimony, maximum likelihood, or Bayesian). Nodes in the tree represent distinct ancestral sequences and the confidence of any node is provided by a bootstrap or Bayesian posterior probability, which measures branch uncertainty.

"Prediabetes" refers a condition in which blood glucose levels are higher than normal, but not high enough to be classified as diabetes. Individuals with pre-diabetes are at increased risk of developing type 2 diabetes within a decade. According to CDC, prediabetes can be diagnosed by fasting glucose levels between 100-125 mg/dL, 2 hour post-glucose load plasma glucose in oral glucose tolerance test (OGTT) between 140 and 199 mg/dL, or hemoglobin A1c test between 5.7%-6.4%.

"rDNA," "rRNA," "16S-rDNA." "16S-rRNA," "16S," "16S sequencing," "16S-NGS," "18S," "18S-rRNA," "18S-rDNA," "18S sequencing," and "18S-NGS" refer to the nucleic acids that encode for the RNA subunits of the ribosome. rDNA refers to the gene that encodes the rRNA that comprises the RNA subunits. There are two RNA subunits in the ribosome termed the small subunit (SSU) and large subunit (LSU); the RNA genetic sequences (rRNA) of these subunits is related to the gene that encodes them (rDNA) by the genetic code. rDNA genes and their complementary RNA sequences are widely used for determination of the evolutionary relationships amount organisms as they are variable, yet sufficiently conserved to allow cross organism molecular comparisons. Typically 16S rDNA sequence (approximately 1542 nucleotides in length) of the 30S SSU is used for molecular-based taxonomic assignments of prokaryotes and the 18S rDNA sequence (approximately 1869 nucleotides in length) of 40S SSU is used for eukaryotes. 16S sequences are used for phylogenetic reconstruction as they are in general highly conserved, but contain specific hypervariable regions that harbor sufficient nucleotide diversity to differentiate genera and species of most bacteria.

"Residual habitat products" refers to material derived from the habitat for microbiota within or on a human or animal. For example, microbiota live in stool in the gastrointestinal tract, on the skin itself, in saliva, mucus of the respiratory tract, or secretions of the genitourinary tract (i.e., biological matter associated with the microbial community). Substantially free of residual habitat products means that the bacterial composition no longer contains the biological matter associated with the microbial environment on or in the human or animal subject and is 100% free, 99% free, 98% free, 97% free, 96% free, or 95% free of any contaminating biological matter associated with the microbial community. Residual habitat products can include abiotic materials (including undigested food) or it can include unwanted microorganisms. Substantially free of residual habitat products may also mean that the bacterial composition contains no detectable cells from a human or animal and that only microbial cells are detectable. In one embodiment, substantially free of residual habitat products may also mean that the bacterial composition contains no detectable viral (including bacterial viruses, i.e., phage), fungal, mycoplasmal contaminants. In another embodiment, it means that fewer than $1 \times 10-2\%$, $1 \times 10-3\%$, $1 \times 10-4\%$, $1 \times 10-5\%$, $1 \times 10-6\%$, $1 \times 10-7\%$, $1 \times 10-8$ of the viable cells in the bacterial composition are human or animal, as compared to microbial cells. There are multiple ways to accomplish this degree of purity, none of which are limiting. Thus, contamination may be reduced by isolating desired constituents through multiple steps of streaking to single colonies on solid media until replicate (such as, but not limited to, two) streaks from serial single colonies have shown only a single colony morphology. Alternatively, reduction of contamination can be accomplished by multiple rounds of serial dilutions to single desired cells (e.g., a dilution of 10-8 or 10-9), such as through multiple 10-fold serial dilutions. This can further be confirmed by showing that multiple isolated colonies have similar cell shapes and Gram staining behavior. Other methods for confirming adequate purity include genetic analysis (e.g., PCR, DNA sequencing), serology and antigen analysis, enzymatic and metabolic analysis, and methods using instrumentation such as flow cytometry with reagents that distinguish desired constituents from contaminants.

"Synergy" refers to an effect produced by a combination, e.g., of two microbes (for example, microbes or two different species or two different clades) that is greater than the expected additive effectives of the combination components. In certain embodiments, "synergy" between two or more microbes can result in the inhibition of a pathogens ability to grow. For example, ternary combinations synergistically inhibit *C. difficile* if their mean log inhibition is greater than the sum of the log inhibition of homotrimers of each constituent bacterium divided by three to account for the three-fold higher dose of each strain or for binary combinations, the log inhibition of a homodimer of each constituent bacterium divided by two. In another example, synergy can be calculated by defining the OTU compositions that demonstrate greater inhibition than that represented by the sum of the log inhibition of each bacterium tested separately. In other embodiments, synergy can be defined as a property of compositions that exhibit inhibition greater than the maximum log inhibition among those of each constituent bacterium's homodimer or homotrimer measured independently. As used herein, "synergy" or "synergistic interactions" refers to the interaction or cooperation of two or more microbes to produce a combined effect greater than the sum of their separate effects.

"Spore" or a population of "spores" includes bacteria (or other single-celled organisms) that are generally viable, more resistant to environmental influences such as heat and bacteriocidal agents than vegetative forms of the same bacteria, and typically capable of germination and outgrowth. Spores are characterized by the absence of active metabolism until they respond to specific environmental signals, causing them to germinate. "Spore-formers" or bacteria "capable of forming spores" are those bacteria containing the genes and other necessary abilities to produce spores under suitable environmental conditions.

"Spore population" refers to a plurality of spores present in a composition. Synonymous terms used herein include spore composition, spore preparation, ethanol-treated spore fraction and spore ecology. A spore population may be purified from a fecal donation, e.g., via ethanol or heat treatment, or a density gradient separation or any combination of methods described herein to increase the purity, potency and/or concentration of spores in a sample. Alternatively, a spore population may be derived through culture methods starting from isolated spore former species or spore former OTUs or from a mixture of such species, either in vegetative or spore form.

In one embodiment, the spore preparation comprises spore forming species wherein residual non-spore forming species have been inactivated by chemical or physical treatments including ethanol, detergent, heat, sonication, and the like; or wherein the non-spore forming species have been removed from the spore preparation by various separations steps including density gradients, centrifugation, filtration and/or chromatography; or wherein inactivation and separation methods are combined to make the spore preparation. In yet another embodiment, the spore preparation comprises spore forming species that are enriched over viable non-spore formers or vegetative forms of spore formers. In this embodiment, spores are enriched by 2-fold, 5-fold, 10-fold, 50-fold, 100-fold, 1000-fold, 10,000-fold or greater than 10,000-fold compared to all vegetative forms of bacteria. In yet another embodiment, the spores in the spore preparation undergo partial germination during processing and formulation such that the final composition comprises spores and vegetative bacteria derived from spore forming species.

"Sporulation induction agent" is a material or physical-chemical process that is capable of inducing sporulation in a bacterium, either directly or indirectly, in a host organism and/or in vitro.

To "increase production of bacterial spores" includes an activity or a sporulation induction agent. "Production" includes conversion of vegetative bacterial cells into spores and augmentation of the rate of such conversion, as well as decreasing the germination of bacteria in spore form, decreasing the rate of spore decay in vivo, or ex vivo, or to increasing the total output of spores (e.g., via an increase in volumetric output of fecal material).

"Subject" refers to any animal subject including humans, laboratory animals (e.g., non-human primates, rats, mice), livestock (e.g., cows, sheep, goats, pigs, turkeys, and chickens), and household pets (e.g., dogs, cats, and rodents). The subject may be suffering from a dysbiosis, that contributes to or causes a condition classified as diabetes or pre-diabetes, including but not limited to mechanisms such as metabolic endotoxemia, altered metabolism of primary bile acids, immune system activation, or an imbalance or reduced production of short chain fatty acids including butyrate, propionate, acetate, and branched chain fatty acids.

"Trimer" refers to a combination of bacteria that is comprised of three OTUs. The descriptions "homotrimer" and "heterotrimer" refer to combinations where all three OTUs are the same or different, respectively. A "semi-heterotrimer" refers to combinations where two constituents are the same with a third that is different As used herein the term "vitamin" is understood to include any of various fat-soluble or water-soluble organic substances (non-limiting examples include vitamin A, vitamin B1 (thiamine), vitamin B2 (riboflavin), vitamin B3 (niacin or niacinamide), vitamin B5 (pantothenic acid), vitamin B6 (pyridoxine, pyridoxal, or pyridoxamine, or pyridoxine hydrochloride), vitamin B7 (biotin), vitamin B9 (folic acid), and Vitamin B12 (various cobalamins; commonly cyanocobalamin in vitamin supplements), vitamin C, vitamin D, vitamin E, vitamin K, K1 and K2 (i.e., MK-4, MK-7), folic acid and biotin) essential in minute amounts for normal growth and activity of the body and obtained naturally from plant and animal foods or synthetically made, pro-vitamins, derivatives, analogs.

"V1-V9 regions" or "16S V1-V9 regions" refers to the first through ninth hypervariable regions of the 16S rDNA gene that are used for genetic typing of bacterial samples. These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature (Brosius et al., 1978. Complete nucleotide sequence of a 16S ribosomal RNA gene from *Escherichia coli*, PNAS USA 75(10):4801-4805). In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU. A person of ordinary skill in the art can identify the specific hypervariable regions of a candidate 16S rDNA by comparing the candidate sequence in question to a reference sequence and identifying the hypervariable regions based on similarity to the reference hypervariable regions, or alternatively, one can employ Whole Genome Shotgun (WGS) sequence characterization of microbes or a microbial community.

DETAILED DESCRIPTION

Applicants have discovered combinations of bacteria that, when present, are associated with improvement in the microbiome of a subject, e.g., a subject having a dysbiosis such as a dysbiosis associated with *C. difficile*. In addition, combinations of microorganisms have been identified that are associated with the engraftment and/or augmentation of organisms associated with a healthy microbiome. Applicants have also identified combinations of microorganisms that can be useful for treating antibiotic-resistant or other pathogenic bacterial conditions. In some embodiments the microbial content of such a composition comprises the organisms, in other embodiments, the microbial content of the composition consists essentially of the organisms, and in other embodiments, the microbial content of the composition consists of the organisms. In all cases, the composition may include non-microbial components. In some cases, the composition comprises at least two organisms (e.g., three organisms) or more, as are described herein.

Emergence of Antibiotic Resistance in Bacteria

Antibiotic resistance is an emerging public health issue (Carlet et al., 2011. Society's failure to protect a precious resource: antibiotics. Lancet 378: 369-371). Numerous genera of bacteria harbor species that are developing resistance to antibiotics. These include but are not limited to vancomycin resistant *Enterococcus* (VRE) and carbapenem resistant *Klebsiella* (CRKp). *Klebsiella pneumoniae* and *Escherichia coli* strains are becoming resistant to carbapenems and require the use of old antibiotics characterized by high toxicity, such as colistin (Cantón et al. 2012. Rapid evolution and spread of carbapenemases among Enterobacteriaceae in Europe. Clin Microbiol Infect 18: 413-431). Additional multiply drug resistant strains of multiple species, including *Pseudomonas aeruginosa, Enterobacter* spp., and *Acinetobacter* spp. are observed clinically including isolates that are highly resistant to ceftazidime, carbapenems, and quinolones (European Centre for Disease Prevention and Control: EARSS net database, http://ecdc.europa.eu.). The Centers for Disease Control and Prevention in 2013 released a Threat Report (http://www.cdc.gov/drugresistance/threat-report-2013/) citing numerous bacterial infection threats that included *Clostridium difficile*, carbapenem-resistant Enterobacteriaceae (CRE), multidrug-resistant *Acinetobacter*, drug-resistant *Campylobacter*, extended spectrum β-lactamase producing Enterobacteriaceae (ESBLs), vancomycin-resistant *Enteroccoccus* (VRE), multidrug-resistant *Pseudomonas aeruginosa*, drug-resistant non-typhoidal *Salmonella*, drug-resistant *Salmonella typhi*, drug-resistant *Shigella*, methicillin-resistant *Staphylococcus aureus* (MRSA), drug-resistant *Streptococcus pneumoniae*, vancomycin-resistant *Staphylococcus aureus* (VRSA), erythromycin-resistant Group A *Streptococcus*, and clindamycin-resistant Group B *Streptococcus*. The increasing failure of antibiotics due the rise of resistant microbes demands new therapeutics to treat bacterial infections. Administration of a microbiome therapeutic bacterial composition offers potential for such therapies.

Applicants have discovered that subjects suffering from recurrent *C. difficile* associated diarrhea (CDAD) often harbor antibiotic resistant Gram-negative bacteria, in particular Enterobacteriaceae and that treatment with a bacterial composition effectively treats CDAD and reduces the antibiotic resistant Gram-negative bacteria. The gastrointestinal tract is implicated as a reservoir for many of these organisms including VRE, MRSA, *Pseudomonas aeruginosa, Acinetobacter* and the yeast *Candida* (Donskey, Clinical Infectious Diseases 2004 39:214, The Role of the Intestinal Tract as a Reservoir and Source for Transmission of Nosocomial Pathogens), and thus as a source of nosocomial infections. Antibiotic treatment and other decontamination procedures are among the tools in use to reduce colonization of these organisms in susceptible subjects including those who are immunosuppressed. Bacterial-based therapeutics would provide a new tool for decolonization, with a key benefit of not promoting antibiotic resistance as antibiotic therapies do.

Bacterial Compositions

Provided are bacteria and combinations of bacteria of the human gut microbiota with the capacity to meaningfully provide functions of a healthy microbiota or catalyze an augmentation to the resident microbiome when administered to mammalian hosts. In particular, provided are synergistic combinations that treat, prevent, delay or reduce the symptoms of diseases, disorders and conditions associated with a dysbiosis. Representative diseases, disorders and conditions potentially associated with a dysbiosis, which are suitable for treatment with the compositions and methods as described herein, are provided in Table 3. Without being limited to a specific mechanism, it is thought that such compositions inhibit the growth, proliferation, and/or colonization of one or a plurality of pathogenic bacteria in the dysbiotic microbiotal niche, so that a healthy, diverse and protective microbiota colonizes and populates the intestinal lumen to establish or reestablish ecological control over pathogens or potential pathogens (e.g., some bacteria are pathogenic bacteria only when present in a dysbiotic environment). Inhibition of pathogens includes those pathogens such as *C. difficile, Salmonella* spp., enteropathogenic *E. coli*, multi-drug resistant bacteria such as *Klebsiella*, and *E. coli*, carbapenem-resistant Enterobacteriaceae (CRE), extended spectrum beta-lactam resistant Enterococci (ESBL), and vancomycin-resistant Enterococci (VRE).

The bacterial compositions provided herein are produced and the efficacy thereof in inhibiting pathogenic bacteria is demonstrated as provided in further detail herein.

In particular, in order to characterize those antagonistic relationships between gut commensals that are relevant to the dynamics of the mammalian gut habitat, provided is an in vitro microplate-based screening system that demonstrates the efficacy of those bacterial compositions, including the ability to inhibit (or antagonize) the growth of a bacterial pathogen or pathobiont, typically a gastrointestinal microorganism. These methods provide novel combinations of gut microbiota species and OTUs that are able to restore or enhance ecological control over important gut pathogens or pathobionts in vivo.

Bacterial compositions may comprise two types of bacteria (termed "binary combinations" or "binary pairs") or greater than two types of bacteria. Bacterial compositions that comprise three types of bacteria are termed "ternary combinations". For instance, a bacterial composition may comprise at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, or at least 21, 22, 23, 24, 25, 26, 27, 28, 29 30, 31, 32, 33, 34, 35, 36, 37, 38, 39, or at least 40, at least 50 or greater than 50 types of bacteria, as defined by species or operational taxonomic unit (OTU), or otherwise as provided herein. In one embodiment, the composition comprises at least two types of bacteria chosen from Table 1.

In another embodiment, the number of types of bacteria present in a bacterial composition is at or below a known value. For example, in such embodiments the bacterial composition comprises 50 or fewer types of bacteria, such as 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, or 10 or fewer, or 9 or fewer types of bacteria, 8 or fewer types of bacteria, 7 or fewer types of bacteria, 6 or fewer types of bacteria, 5 or fewer types of bacteria, 4 or fewer types of bacteria, or 3 or fewer types of bacteria. In another embodiment, a bacterial composition comprises from 2 to no more than 40, from 2 to no more than 30, from 2 to no more than 20, from 2 to no more than 15, from 2 to no more than 10, or from 2 to no more than 5 types of bacteria.

In some embodiments, bacterial compositions are provided with the ability to exclude pathogenic bacteria. Exemplary bacterial compositions are demonstrated to reduce the growth rate of one pathogen, *C. difficile*, as provided in the Examples, wherein the ability of the bacterial compositions is demonstrated by assessing the antagonism activity of a combination of OTUs or strains towards a given pathogen using in vitro assays.

In some embodiments, bacterial compositions with the capacity to durably exclude *C. difficile*, are developed using a methodology for estimating an Ecological Control Factor (ECF) for constituents within the human microbiota. The ECF is determined by assessing the antagonistic activity of a given commensal strain or combination of strains towards a given pathogen using an in vitro assay, resulting in observed levels of ecological control at various concentrations of the added commensal strains. The ECF for a commensal strain or combination of strains is somewhat analogous to the longstanding minimal inhibitory concentration (MIC) assessment that is employed in the assessment of antibiotics. The ECF allows for the assessment and ranking of relative potencies of commensal strains and combinations of strains for their ability to antagonize gastrointestinal pathogens. The ECF of a commensal strain or combination of strains may be calculated by assessing the concentration of that composition that is able to mediate a given percentage of inhibition (e.g., at least 10%, 20%, 50%, 70%, 75%, 80%, 85%, 90%, 95%, or 100%) of a target pathogen in the in vitro assay. Provided herein are combinations of strains or OTUs within the human microbiota that are able to significantly reduce the rate of gastrointestinal pathogen replication within the in vitro assay. These compositions are capable of providing a safe and effective means by which to affect the growth, replication, and disease severity of such bacterial pathogens.

Bacterial compositions may be prepared comprising at least two types of isolated bacteria, wherein a first type and a second type are independently chosen from the species or OTUs listed in Table 1. Certain embodiments of bacterial compositions with at least two types of isolated bacteria containing binary pairs are reflected in Table 4a. Additionally, a bacterial composition may be prepared comprising at least two types of isolated bacteria, wherein a first OTU and a second OTU are independently characterized by, i.e., at least 95%, 96%, 97%, 98%, 99% or including 100%/o sequence identity to, sequences listed in Table 1. Generally, the first bacteria and the second bacteria are not the same OTU. The sequences provided in the sequencing listing file for OTUs in Table 1 are full 16S sequences. Therefore, in one embodiment, the first and/or second OTUs may be characterized by the full 16S sequences of OTUs listed in Table 1. In another embodiment, the first and/or second OTUs may be characterized by one or more of the variable regions of the 16S sequence (V1-V9). These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature. (See, e.g., Brosius et al., Complete nucleotide sequence of a 16S ribosomal RNA gene from *Escherichia coli*, PNAS 75(10):4801-4805 (1978)). In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU.

Bacterial Compositions Described by Species

In some embodiments, compositions are defined by species included in the composition. Methods of identifying species are known in the art.

Bacterial Compositions Described by Operational Taxonomic Units (OTUs)

OTUs may be defined either by full 16S sequencing of the rDNA gene, by sequencing of a specific hypervariable region of this gene (i.e., V1, V2, V3, V4, V5, V6, V7, V8, or V9), or by sequencing of any combination of hypervariable regions from this gene (e.g., V1-3 or V3-5). The bacterial 16S rDNA is approximately 1500 nucleotides in length and is used in reconstructing the evolutionary relationships and sequence similarity of one bacterial isolate to another using phylogenetic approaches. 16S sequences are used for phylogenetic reconstruction as they are in general highly conserved, but contain specific hypervariable regions that harbor sufficient nucleotide diversity to differentiate genera and species of most microbes. Using well known techniques, in order to determine the full 16S sequence or the sequence of any hypervariable region of the 16S sequence, genomic DNA is extracted from a bacterial sample, the 16S rDNA (full region or specific hypervariable regions) amplified using polymerase chain reaction (PCR), the PCR products cleaned, and nucleotide sequences delineated to determine the genetic composition of 16S gene or subdomain of the gene. If full 16S sequencing is performed, the sequencing method used may be, but is not limited to, Sanger sequencing. If one or more hypervariable regions are used, such as the V4 region, the sequencing may be, but is not limited to being, performed using the Sanger method or using a next-generation sequencing method, such as an Illumina (sequencing by synthesis) method using barcoded primers allowing for multiplex reactions.

Bacterial Compositions Exclusive of Certain Bacterial Species or Strains

In one embodiment, the bacterial composition does not comprise at least one of *Enterococcus faecalis* (previously known as *Streptococcus faecalis*), *Clostridium innocuum*, *Clostridiumn ramosum*, *Bacteroides ovatus*, *Bacteroides vulgatus*, *Bacteroides thetaoiotaomicron*, *Escherichia coli* (1109 and 1108-1), *Clostridium bifermentans*, and *Blautia producta* (previously known as *Peptostreptococcus productus*).

In another embodiment, the bacterial composition does not comprise at least one of *Acidaminococcus intestinalis*, *Bacteroides ovatus*, two species of *Bifidobacterium adolescentis*, two species of *Bifidobacterium longum*, *Collinsella aerofaciens*, two species of *Dorea longicatena*, *Escherichia coli*, *Eubacterium eligens*, *Eubacterium limosum*, four species of *Eubacterium rectale*, *Eubacterium ventriosumi*, *Faecalibacterium prausnitzii*, *Lactobacillus casei*, *Lactobacillus paracasei*, *Paracateroides distasonis*, *Raoultella* sp., one species of *Roseburia* (chosen from *Roseburia faecalis* or *Roseburia faecis*). *Roseburia intestinalis*, two species of *Ruminococcus torques*, and *Streptococcus mitis*.

In another embodiment, the bacterial composition does not comprise at least one of *Barnesiella intestinihominis*; *Lactobacillus reuteri*; a species characterized as one of *Enterococcus hirae*, *Enterococcus faecium*, or *Enterococcus durans*; a species characterized as one of *Anaerostipes caccae* or *Clostridium indolis*; a species characterized as one of *Staphylococcus warneri* or *Staphylococcus pasteuri*; and *Adlercreuizia equolifaciens*.

In another embodiment, the bacterial composition does not comprise at least one of *Clostridium absonum*, *Clostridium argentinense*, *Clostridium baratii*, *Clostridium bifermentans*, *Clostridium botulinum*, *Clostridium butyricum*, *Clostridium cadaveris*, *Clostridium camis*, *Clostridium celatum*, *Clostridium chauvoei*, *Clostridium clostridioforme*, *Clostridium cochlearium*, *Clostridium difficile*, *Clostridium fallax*, *Clostridium felsineum*, *Clostridium ghonii*, *Clostridium glycolicum*, *Clostridium haemolyticum*, *Clostridium hastiforme*, *Clostridium histolyticum*, *Clostridium indolis*, *Clostridium innocuum*, *Clostridium irregulare*, *Clostridium limosum*, *Clostridium malenominatum*, *Clostridium novvi*, *Clostridium oroticum*, *Clostridium paraputrificum*, *Clostridium perfringens*, *Clostridium piliforme*, *Clostridium putrefaciens*, *Clostridium putrificum*, *Clostridium ramosum*, *Clostridium sardiniense*, *Clostridium sartagoforme*, *Clostridium scindens*, *Clostridium septicum*, *Clostridium sordellii*, *Clostridium sphenoides*, *Clostridium spiroforme*, *Clostridium sporogenes*, *Clostridium subterminale*, *Clostridium symbiosum*, *Clostridium tertium*, *Clostridium tetani*, *Clostridium welchii*, and *Clostridium villosum*.

In another embodiment, the bacterial composition does not comprise at least one of *Clostridium innocuum*, *Clostri-*

*dum bifermentans, Clostridium butyricum, Bacteroides fragilis, Bacteroides thetaiotaomicron, Bacteroides uniformis,* three strains of *Escherichia coli,* and *Lactobacillus* sp.

In another embodiment, the bacterial composition does not comprise at least one of *Clostridium bifermentans, Clostridium innocuum, Clostridium butyricum,* three strains of *Escherichia coli,* three strains of *Bacteroides,* and *Blautia producta* (previously known as *Peptostreptococcus productus*).

In another embodiment, the bacterial composition does not comprise at least one of *Bacteroides* sp., *Escherichia coli,* and non-pathogenic Clostridia, including *Clostridium innocuum, Clostridium bifermentans* and *Clostridium ramosum.*

In another embodiment, the bacterial composition does not comprise at least one of more than one *Bacteroides* species, *Escherichia coli* and non-pathogenic Clostridia, such as *Clostridium butyricum, Clostridium bifermentans* and *Clostridium innocuum.*

In another embodiment, the bacterial composition does not comprise at least one of *Bacteroides caccae, Bacteroides capillosus, Bacteroides coagulans, Bacteroides distasonis, Bacteroides eggerthii, Bacteroides forsythus, Bacteroides fragilis, Bacteroides fragilis-ryhm, Bacteroides gracilis, Bacteroides levii, Bacteroides macacae, Bacteroides merdae, Bacteroides ovatlus, Bacteroides pneumosintes, Bacteroides putredinis, Bacteroides pyogenes, Bacteroides splanchnicus, Bacteroides stercoris, Bacteroides tectum, Bacteroides thetaiotaomicron, Bacteroides uniformis, Bacteroides ureolyticus,* and *Bacteroides vulgatus.*

In another embodiment, the bacterial composition does not comprise at least one of *Bacteroides, Eubacteria, Fusobacteria, Propionibacteria, Lactobacilli,* anaerobic cocci, *Ruminococcus, Escherichia coli, Gemmiger, Desulfomonas,* and *Peptostreptococcus.*

In another embodiment, the bacterial composition does not comprise at least one of *Bacteroides fragilis* ss. *Vulgatus, Eubacterium aerofaciens, Bacteroides fragilis* ss. *Thetaiotaomicron, Blautia producta* (previously known as *Peptostreptococcus productus* II), *Bacteroides fragilis* ss. *Distasonis, Fusobacterium prausnitzii, Coprococcus eutactus, Eubacterium aerofaciens* III, *Blautia producta* (previously known as *Peptostreptococcus productus* I), *Ruminococcus bromii, Bifidobacterium adolescentis, Gemmiger formicilis, Bifidobacterium longum, Eubacterium siraeum, Ruminococcus torques, Eubacterium rectale* III-H. *Eubacterium rectale* IV. *Eubacterium eligens, Bacteroides eggerthii, Clostridium leptum, Bacteroides fragilis* ss. A., *Eubacterium biforme, Bifidobacterium infantis, Eubacterium rectale* III-F, *Coprococcus comes, Bacteroides capillosus, Ruminococcus albus, Eubacterium formicigenerans, Eubacterium hallii, Eubacterium ventriosum* I, *Fusobacterium russii, Ruminococcus obeum, Eubacterium rectale* II, *Clostridium ramosum* 1, *Lactobacillus leichmanii, Ruminococcus cailidus, Butyrivibrio crossotus, Acidaminococcus fermentans, Eubacterium ventriosum, Bacteroides fragilis* ss. *fragilis, Bacteroides* AR, *Coprococcus catus, Eubacterium hadrum, Eubacterium cylindroides, Eubacterium ruminantium, Eubacterium* CH-1, *Staphylococcus epidermidis, Peptostreptococcus* BL, *Eubacterium limosum, Bacteroides praeacutus, Bacteroides* L, *Fusobacterium mortiferum* I, *Fusobacterium naviforme, Clostridium innocuum, Clostridium ramosum, Propionibacterium acnes, Ruminococcus flavefaciens, Ruminococcus* AT, *Peptococcus* AU-1, *Eubacterium* AG, -AK, -AL, -AL-1, -AN; *Bacteroides fragilis* ss. *ovatus,* -ss. d, -ss. f; *Bacteroides* L-1, L-5; *Fusobacterium nucleatum, Fusobacterium mortiferum, Escherichia coli, Streptococcus morbiliorum, Peptococcus magnus, Peptococcus* G, AU-2; *Streptococcus intermedius, Ruminococcus lactaris, Ruminococcus* CO *Gemmiger* A *Coprococcus* BH, -CC; *Eubacterium tenue, Eubacterium ramulus, Eubacterium* AE, -AG-H, -AG-M, -AJ, -BN-1; *Bacteroides clostridiiformis* ss. *clostridiiformis, Bacteroides coagulans, Bacteroides orails, Bacteroides ruminicola* ss. *brevis,* -ss. *ruminicola, Bacteroides splanchnicus, Desuifomonas pigra, Bacteroides* L-4, -N-i; *Fusobacterium* H, *Lactobacillus* G, and *Succinivibrio* A.

In another embodiment, the bacterial composition does not comprise at least one of *Bifidobacterium bifidum* W23, *Bifidobacterium lactis* W18, *Bifidobacterium longum* W51, *Enterococcus faecium* W54, *Lactobacillus plantarum* W62, *Lactobacillus rhamnosus* W71, *Lactobacillus acidophilus* W37, *Lactobacillus acidophilus* W55, *Lactobacillus paracasei* W20, and *Lactobacillus salivarius* W24.

In another embodiment, the bacterial composition does not comprise at least one of *Anaerotruncus colihominis* DSM 17241, *Blautia producta* JCM 1471, *Clostridiales bacterium* I 7 47FAA, *Clostridium asparagiforme* DSM 15981, *Clostridium bacterium,* JC13, *Clostridium bolteae* ATCC BAA 613. *Clostridium hathewayi* DSM 13479, *Clostridium indolis* CM971, *Clostridium ramosum* DSM 1402, *Clostridium saccharogumia* SDG Mt85 3Db, *Clostridium scindens* VP 12708, *Clostridium* sp 7 3 54F4A, *Eubacterium contortum* DSM 3982, Lachnospiraceae bacterium 3 1 57FAA CT1, Lachnospiraceae bacterium 7 1 58FAA, and *Ruminococcus* sp ID8.

In another embodiment, the bacterial composition does not comprise at least one of *Anaerotruncus colihominis* DSM 17241, *Blautia producta* JCM 1471, *Clostridiales bacterium* I 7 47FAA, *Clostridium asparagiforme* DSM 15981, *Clostridium bacterium* JC13. *Clostridium bolteae* ATCC BAA 613. *Clostridium hathewayi* DSM 13479, *Clostridium indolis* CM971, *Clostridium ramosum* DSM 1402, *Clostridium saccharogumia* SDG Mt85 3Db, *Clostridium scindens* VP 12708, *Clostridium* sp 7 3 54FAA, *Eubacterium contortum* DSM 3982, Lachnospiraceae bacterium 3 1 57FAA CT1, Lachnospiraceae bacterium 7 1 58FAA, Oscillospiraceae bacterium NML 061048, and *Ruminococcus* sp ID8.

In another embodiment, the bacterial composition does not comprise at least one of *Clostridium ramosum* DSM 1402, *Clostridium saccharogumia* SDG Mt85 3Db, and Lachnospiraceae bacterium 7 1 58FAA.

In another embodiment, the bacterial composition does not comprise at least one of *Clostridium hathewayi* DSAM 13479. *Clostridium saccharogumia* SDG Mt85 3Db, *Clostridium* sp 7 3 54FAA, and Lachnospiraceae bacterium 3 1 57FAA CT1.

In another embodiment, the bacterial composition does not comprise at least one of *Anaerotruncus colihominis* DSAM 17241. *Blautia producta* JCM 1471, *Clostridium bacterium* JC13, *Clostridium scindens* VP 12708, and *Ruminococcus* sp ID8.

In another embodiment, the bacterial composition does not comprise at least one of *Clostridiales bacterium* 1 7 47FAA, *Clostridium asparagiforme* DSM 15981, *Clostridium bolteae* ATCC BAA 613. *Clostridium indolis* CM971, and Lachnospiraceae bacterium 7 1 58FAA.

Inhibition of Bacterial Pathogens

The bacterial compositions offer a protective or therapeutic effect against infection by one or more GI pathogens of interest, some of which are listed in Table 3.

In some embodiments, the pathogenic bacterium is selected from the group consisting of *Yersinia, Vibrio, Treponema, Streptococcus, Staphylococcus, Shigella, Sal-* monella, Rickettsia, Orientia, Pseudomonas, Neisseria, Mycoplasma, Mycobacterium, Listeria, Leptospira, Legionella, Klebsiella, Helicobacter, Haemophilus, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus, multi-drug resistant bacteria, extended spectrum beta-lactam resistant Enterococci (ESBL), carbapenem-resistant Enterobacteriaceae (CRE), and vancomycin-resistant Enterococci (VRE).

In some embodiments, these pathogens include, but are not limited to, Aeromonas hydrophila, Campylobacter fetus, Plesiomonas shigelloides, Bacillus cereus, Campylobacter jejuni, Clostridium botulinum, Clostridium difficile, Clostridium perfringens, enteroaggregative Escherichia coli, enterohemorrhagic Escherichia coli, enteroinvasive Escherichia coli, enterotoxigenic Escherichia coli (such as, but not limited to, LT and/or ST), Escherichia coli 0157:H7, Fusarium spp., Helicobacter pylori, Klebsiella pneumonia, Klebsiella oxytoca, Lysteria monocytogenes, Morganella spp., Plesiomonas shigelloides, Proteus spp., Providencia spp., Salmonella spp., Salmonella typhi, Salmonella paratyphi, Shigella spp., Staphylococcus spp., Staphylococcus aureus, vancomycin-resistant enterococcus spp., Vibrio spp., Vibrio cholerae, Vibrio parahaemolyticus, Vibrio vulnificus, and Yersinia enterocolitica.

In one embodiment, the pathogen of interest is at least one pathogen chosen from Clostridium difficile, Salmonella spp., pathogenic Escherichia coli, vancomycin-resistant Enterococcus spp., and extended spectrum beta-lactam resistant Enterococci (ESBL).

In Vitro Assays Substantiating Protective Effect of Bacterial Compositions

In one embodiment, provided is an in vitro assay utilizing competition between the bacterial compositions or subsets thereof and C. difficile. Exemplary embodiments of the assay are provided herein and in the Examples.

In another embodiment, provided is an in vitro assay utilizing 10% (wt/vol) Sterile-Filtered Stool (SFS). Provided is an in vitro assay to test for the protective effect of the bacterial compositions and to screen in vitro for combinations of microbes that inhibit the growth of a pathogen. The assay can operate in automated high-throughput or manual modes. Under either system, human or animal stool may be re-suspended in an anaerobic buffer solution, such as pre-reduced PBS or other suitable buffer, the particulate removed by centrifugation, and filter sterilized. This 10% sterile-filtered stool material serves as the base media for the in vitro assay. To test a bacterial composition, an investigator may add it to the sterile-filtered stool material for a first incubation period and then may inoculate the incubated microbial solution with the pathogen of interest for a second incubation period. The resulting titer of the pathogen may be quantified by any number of methods such as those described below, and the change in the amount of pathogen is compared to standard controls including the pathogen cultivated in the absence of the bacterial composition. The assay is conducted using at least one control. Stool from a healthy subject may be used as a positive control. As a negative control, antibiotic-treated stool or heat-treated stool may be used. Various bacterial compositions may be tested in this material and the bacterial compositions optionally compared to the positive and/or negative controls. The ability to inhibit the growth of the pathogen may be measured by plating the incubated material on C. difficile selective media and counting colonies. After competition between the bacterial composition and C. difficile, each well of the in vitro assay plate is serially diluted ten-fold six times, and plated on selective media, such as but not limited to cycloserine cefoxitin mannitol agar (CCMA) or cycloserine cefoxitin fructose agar (CCFA), and incubated. Colonies of C. difficile are then counted to calculate the concentration of viable cells in each well at the end of the competition. Colonies of C. difficile are confirmed by their characteristic diffuse colony edge morphology as well as fluorescence under UV light.

In another embodiment, the in vitro assay utilizes Antibiotic-Treated Stool. In an alternative embodiment, and instead of using 10% sterile-filtered stool, human or animal stool may be resuspended in an anaerobic buffer solution, such as pre-reduced PBS or other suitable buffer. The resuspended stool is treated with an antibiotic, such as clindamycin, or a cocktail of several antibiotics in order to reduce the ability of stool from a healthy subject to inhibit the growth of C. difficile; this material is termed the antibiotic-treated matrix. While not being bound by any mechanism, it is believed that beneficial bacteria in healthy subjects protects them from infection by competing out C. difficile. Treating stool with antibiotics kills or reduces the population of those beneficial bacteria, allowing C. difficile to grow in this assay matrix. Antibiotics in addition to clindamycin that inhibit the normal flora include ceftriaxone and piperacillin-tazobactam and may be substituted for the clindamycin. The antibiotic-treated matrix is centrifuged, the supernatant removed, and the pelleted material resuspended in filter-sterilized, diluted stool in order to remove any residual antibiotic. This washed antibiotic-treated matrix may be used in the in vitro assay described above in lieu of the 10% sterile-filtered stool.

Also provided is an In Vitro Assay utilizing competition between the bacterial compositions or subsets thereof and Vancomycin-resistant Enterococcus faecium. Exemplary embodiments of this Assay are provided herein and in the Examples.

Also provided is an in vitro assay utilizing competition between the bacterial compositions or subsets thereof and Morganella morganii. Exemplary embodiments of this Assay are provided herein and in the Examples.

Also provided is an in vitro assay utilizing competition between the bacterial compositions or subsets thereof and Klebsiella pneumoniae. Exemplary embodiments of this Assay are provided herein and in the Examples.

Alternatively, the ability to inhibit the growth of the pathogen may be measured by quantitative PCR (qPCR). Standard techniques may be followed to generate a standard curve for the pathogen of interest. Genomic DNA may be extracted from samples using commercially available kits, such as the Mo Bio Powersoil®-htp 96 Well Soil DNA Isolation Kit (Mo Bio Laboratories, Carlsbad, Calif.), the Mo Bio Powersoil® DNA Isolation Kit (Mo Bio Laboratories, Carlsbad, Calif.), or the QIAamp DNA Stool Mini Kit (QIAGEN, Valencia, Calif.) according to the manufacturer's instructions. The qPCR may be conducted using HotMasterMix (5PRIME, Gaithersburg, Md.) and primers specific for the pathogen of interest, and may be conducted on a MicroAmp® Fast Optical 96-well Reaction Plate with Barcode (0.1 mL) (Life Technologies, Grand Island, N.Y.) and performed on a BioRad C1000™ Thermal Cycler equipped with a CFX96™ Real-Time System (BioRad, Hercules, Calif.), with fluorescent readings of the FAM and ROX channels. The Cq value for each well on the FAM channel is determined by the CFX Manager™ software version 2.1. The $\log_{10}$ (cfu/ml) of each experimental sample is calculated by inputting a given sample's Cq value into linear regression model generated from the standard curve comparing the Cq values of the standard curve wells to the known $\log_{10}$ (cfu/ml) of those samples. The skilled artisan may employ alternative qPCR modes.

In Vivo Assay Establishing Protective Effect of Bacterial Compositions.

Provided is an in vivo mouse model to test for the protective effect of the bacterial compositions against *C. difficile*. In this model (based on Chen, et al., A mouse model of *Clostridium difficile* associated disease, Gastroenterology 135(6): 1984-1992 (2008)), mice are made susceptible to *C. difficile* by a 7 day treatment (days −12 to −5 of experiment) with 5 to 7 antibiotics (including kanamycin, colistin, gentamycin, metronidazole and vancomycin and optionally including ampicillin and ciprofloxacin) delivered via their drinking water, followed by a single dose with Clindamycin on day −3, then challenged three days later on day 0 with 10 spores of *C. difficile* via oral gavage (i.e., oro-gastric lavage). Bacterial compositions may be given either before (prophylactic treatment) or after (therapeutic treatment) *C. difficile* gavage. Further, bacterial compositions may be given after (optional) vancomycin treatment (see below) to assess their ability to prevent recurrence and thus suppress the pathogen in vivo. The outcomes assessed each day from day −1 to day 6 (or beyond, for prevention of recurrence) are weight, clinical signs, mortality and shedding of *C. difficile* in the stool. Weight loss, clinical signs of disease, and *C. difficile* shedding are typically observed without treatment. Vancomycin provided by oral gavage on days −1 to 4 protects against these outcomes and serves as a positive control. Clinical signs are subjective, and scored each day by the same experienced observer. Animals that lose greater than or equal to 25% of their body weight are euthanized and counted as infection-related mortalities. Stool are gathered from mouse cages (5 mice per cage) each day, and the shedding of *C. difficile* spores is detected in the stool using a selective plating assay as described for the in vitro assay above, or via qPCR for the toxin gene as described herein. The effects of test materials including 10% suspension of human stool (as a positive control), bacterial compositions, or PBS (as a negative vehicle control), are determined by introducing the test article in a 0.2 mL volume into the mice via oral gavage on day −1, one day prior to *C. difficile* challenge, on day 1, 2 and 3 as treatment or post-vancomycin treatment on days 5, 6, 7 and 8. Vancomycin, as discussed above, is given on days 1 to 4 as another positive control. Alternative dosing schedules and routes of administration (e.g., rectal) may be employed, including multiple doses of test article, and $10^3$ to $10^{10}$ of a given organism or composition may be delivered.

Methods for Preparing a Bacterial Composition for Administration to a Subject

Methods for producing bacterial compositions may include three main processing steps, combined with one or more mixing steps. The steps are: organism banking, organism production, and preservation.

For banking, the strains included in the bacterial composition may be (1) isolated directly from a specimen or taken from a banked stock, (2) optionally cultured on a nutrient agar or broth that supports growth to generate viable biomass, and (3) the biomass optionally preserved in multiple aliquots in long-term storage.

In embodiments using a culturing step, the agar or broth may contain nutrients that provide essential elements and specific factors that enable growth. An example would be a medium composed of 20 g/L glucose, 10 g/L yeast extract, 10 g/L soy peptone, 2 g/L citric acid, 1.5 g/L sodium phosphate monobasic, 100 mg/L ferric ammonium citrate, 80 mg/L magnesium sulfate, 10 mg/L hemin chloride, 2 mg/L calcium chloride, 1 mg/L menadione. A variety of microbiological media and variations are well known in the art (e.g., R. M. Atlas, *Handbook of Microbiological Media* (2010) CRC Press). Medium can be added to the culture at the start, may be added during the culture, or may be intermittently/continuously flowed through the culture. The strains in the bacterial composition may be cultivated alone, as a subset of the bacterial composition, or as an entire collection comprising the bacterial composition. As an example, a first strain may be cultivated together with a second strain in a mixed continuous culture, at a dilution rate lower than the maximum growth rate of either cell to prevent the culture from washing out of the cultivation.

The inoculated culture is incubated under favorable conditions for a time sufficient to build biomass. For bacterial compositions for human use this is often at 37° C. temperature, pH, and other parameter with values similar to the normal human niche. The environment may be actively controlled, passively controlled (e.g., via buffers), or allowed to drift. For example, for anaerobic bacterial compositions (e.g., gut microbiota), an anoxic/reducing environment may be employed. This can be accomplished by addition of reducing agents such as cysteine to the broth, and/or stripping it of oxygen. As an example, a culture of a bacterial composition may be grown at 37° C., pH 7, in the medium above, pre-reduced with 1 g/L cysteine HCl.

When the culture has generated sufficient biomass, it may be preserved for banking. The organisms may be placed into a chemical milieu that protects from freezing (adding 'cryoprotectants'), drying ('lyoprotectants'), and/or osmotic shock ('osmoprotectants'), dispensing into multiple (optionally identical) containers to create a uniform bank, and then treating the culture for preservation. Containers are generally impermeable and have closures that assure isolation from the environment. Cryopreservation treatment is accomplished by freezing a liquid at ultra-low temperatures (e.g., at or below −80° C.). Dried preservation removes water from the culture by evaporation (in the case of spray drying or 'cool drying') or by sublimation (e.g., for freeze drying, spray freeze drying). Removal of water improves long-term bacterial composition storage stability at temperatures elevated above cryogenic. If the bacterial composition comprises spore forming species and results in the production of spores, the final composition may be purified by additional means such as density gradient centrifugation preserved using the techniques described above. Bacterial composition banking may be done by culturing and preserving the strains individually, or by mixing the strains together to create a combined bank. As an example of cryopreservation, a bacterial composition culture may be harvested by centrifugation to pellet the cells from the culture medium, the supernatant decanted and replaced with fresh culture broth containing 15% glycerol. The culture can then be aliquoted into 1 mL cryotubes, sealed, and placed at −80° C. for long-term viability retention. This procedure achieves acceptable viability upon recovery from frozen storage.

Organism production may be conducted using similar culture steps to banking, including medium composition and culture conditions. It may be conducted at larger scales of operation, especially for clinical development or commercial production. At larger scales, there may be several subcultivations of the bacterial composition prior to the final cultivation. At the end of cultivation, the culture is harvested to enable further formulation into a dosage form for administration. This can involve concentration, removal of undesirable medium components, and/or introduction into a chemical milieu that preserves the bacterial composition and renders it acceptable for administration via the chosen route. For example, a bacterial composition may be cultivated to a concentration of $10^{10}$ CFU/mL, then concentrated 20-fold by tangential flow microfiltration; the spent medium may be exchanged by diafiltering with a preservative medium consisting of 2% gelatin, 100 mM trehalose, and 10 mM sodium phosphate buffer. The suspension can then be freeze-dried to a powder and titrated.

After drying, the powder may be blended to an appropriate potency, and mixed with other cultures and/or a filler such as microcrystalline cellulose for consistency and ease of handling, and the bacterial composition formulated as provided herein.

Formulations

Provided are formulations for administration to humans and other subjects in need thereof. Generally the bacterial compositions are combined with additional active and/or inactive materials to produce a final product, which may be in single dosage unit or in a multi-dose format.

In some embodiments the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate may be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments the composition comprises at least one lipid. As used herein a "lipid" includes fats, oils, triglycerides, cholesterol, phospholipids, fatty acids in any form including free fatty acids. Fats, oils and fatty acids can be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, and a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, $C_{12}$-$C_{18}$ fatty acid alcohol, polyethylene glycol, polyols, saccharides, oligosaccharides, and combinations thereof.

In some embodiments the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, microcrystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments the excipient comprises a flavoring agent. Flavoring agents can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; *eucalyptus*; vanilla; citrus oil such as lemon oil, orange oil, grape and grapefruit oil; and fruit essences including apple, peach, pear, strawberry, raspberry, cherry, plum, pineapple, and apricot.

In some embodiments the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2, 2-dioxide, particularly the potassium salt (acesulfame-K), and sodium and calcium salts thereof.

In some embodiments the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 99% or less, such as about 95% or less, about 90% or less, about 85% or less, about 80% or less, about 75% or less, about 70% or less, about 65% or less, about 60% or less, about 55% or less, 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the composition.

The bacterial compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the bacterial composition is administered orally.

Solid dosage forms for oral administration include capsules, tablets, caplets, pills, troches, lozenges, powders, and granules. A capsule typically comprises a core material comprising a bacterial composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In some embodiments the coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the bacterial compositions disclosed herein can be incorporated into a food product. In some embodiments the food product is a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, emulsions, suspensions and solutions and/or suspensions reconstituted from non-effervescent granules, containing at least one of suitable solvents, preservatives, emulsifying agents, suspending agents, diluents, sweeteners, coloring agents, and flavoring agents.

In some embodiments the food product is a solid foodstuff. Suitable examples of a solid foodstuff include without limitation a food bar, a snack bar, a cookie, a brownie, a muffin, a cracker, an ice cream bar, a frozen yogurt bar, and the like.

In some embodiments, the compositions disclosed herein are incorporated into a therapeutic food. In some embodiments, the therapeutic food is a ready-to-use food that optionally contains some or all essential macronutrients and micronutrients. In some embodiments, the compositions disclosed herein are incorporated into a supplementary food that is designed to be blended into an existing meal. In some embodiments, the supplemental food contains some or all essential macronutrients and micronutrients. In some embodiments, the bacterial compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

In one embodiment, the formulations are filled into gelatin capsules for oral administration. An example of an appropriate capsule is a 250 mg gelatin capsule containing from 10 (up to 100 mg) of lyophilized powder ($10^8$ to $10^{11}$ bacteria), 160 mg microcrystalline cellulose, 77.5 mg gelatin, and 2.5 mg magnesium stearate. In an alternative embodiment, from $10^5$ to $10^{12}$ bacteria may be used, $10^5$ to $10^7$, $10^6$ to $10^7$, or $10^8$ to $10^{10}$, with attendant adjustments of the excipients if necessary. In an alternative embodiment an enteric-coated capsule or tablet or with a buffering or protective composition may be used.

In one embodiment, the number of bacteria of each type may be present in the same amount or in different amounts. For example, in a bacterial composition with two types of bacteria, the bacteria may be present in from a 1:10,000 ratio to a 1:1 ratio, from a 1:10,000 ratio to a 1:1,000 ratio, from a 1:1,000 ratio to a 1:100 ratio, from a 1:100 ratio to a 1:50 ratio, from a 1:50 ratio to a 1:20 ratio, from a 1:20 ratio to a 1:10 ratio, from a 1:10 ratio to a 1:1 ratio. For bacterial compositions comprising at least three types of bacteria, the ratio of type of bacteria may be chosen pairwise from ratios for bacterial compositions with two types of bacteria. For example, in a bacterial composition comprising bacteria A, B, and C, at least one of the ratio between bacteria A and B, the ratio between bacteria B and C, and the ratio between bacteria A and C may be chosen, independently, from the pairwise combinations above.

Methods of Treating a Subject

In some embodiments the proteins and compositions disclosed herein are administered to a subject or a user (sometimes collectively referred to as a "subject"). As used herein "administer" and "administration" encompasses embodiments in which one person directs another to consume a bacterial composition in a certain manner and/or for a certain purpose, and also situations in which a user uses a bacteria composition in a certain manner and/or for a certain purpose independently of or in variance to any instructions received from a second person. Non-limiting examples of embodiments in which one person directs another to consume a bacterial composition in a certain manner and/or for a certain purpose include when a physician prescribes a course of conduct and/or treatment to a subject, when a parent commands a minor user (such as a child) to consume a bacterial composition, when a trainer advises a user (such as an athlete) to follow a particular course of conduct and/or treatment, and when a manufacturer, distributer, or marketer recommends conditions of use to an end user, for example through advertisements or labeling on packaging or on other materials provided in association with the sale or marketing of a product.

The bacterial compositions offer a protective and/or therapeutic effect against infection by one or more GI pathogens of interest and thus may be administered after an acute case of infection has been resolved in order to prevent relapse, during an acute case of infection as a complement to antibiotic therapy if the bacterial composition is not sensitive to the same antibiotics as the GI pathogen, or to prevent infection or reduce transmission from disease carriers. These pathogens include, but are not limited to, *Aeromonas hydrophila*, *Campylobacter fetus*, *Plesiomonas shigelloides*, *Bacillus cereus*, *Campylobacter jejuni*, *Clostridium botulinum*, *Clostridium difficile*, *Clostridium perfringens*, enteroaggregative *Escherichia coli*, enterohemorrhagic *Escherichia coli*, enteroinvasive *Escherichia coli*, enterotoxigenic *Escherichia coli* (LT and/or ST), *Escherichia coli* 0157:1-:H7, *Helicobacter pylori*, *Klebsiella pneumonia*, *Lysteria monocytogenes*, *Plesiomonas shigelloides*, *Salmonella* spp., *Salmonella typhi*, *Shigella* spp., *Staphylococcus*, *Staphylococcus aureus*, vancomycin-resistant *Enterococcus* spp., *Vibrio* spp., *Vibrio cholerae*, *Vibrio parahaemnolyticus*, *Vibrio vulnificus*, and *Yersinia enterocolitica*.

In one embodiment, the pathogen may be *Clostridium difficile*, *Salmonella* spp., pathogenic *Escherichia coli*, carbapenem-resistant Enterobacteriaceae (CRE), extended spectrum beta-lactam resistant Enterococci (ESBL) and vancomycin-resistant Enterococci (VRE). In yet another embodiment, the pathogen may be *Clostridium difficile*.

The present bacterial compositions may be useful in a variety of clinical situations. For example, the bacterial compositions may be administered alone, as a complementary treatment to antibiotics (e.g., when a subject is suffering from an acute infection, to reduce the risk of recurrence after an acute infection has subsided or, or when a subject will be in close proximity to others with or at risk of serious gastrointestinal infections (physicians, nurses, hospital workers, family members of those who are ill or hospitalized).

The present bacterial compositions may be administered to animals, including humans, laboratory animals (e.g., primates, rats, mice), livestock (e.g., cows, sheep, goats, pigs, turkeys, chickens), and household pets (e.g., dogs, cats, rodents).

In the present method, the bacterial composition is administered enterically, in other words by a route of access to the gastrointestinal tract. This includes oral administration, rectal administration (including enema, suppository, or colonoscopy), by an oral or nasal tube (nasogastric, nasojejunal, oral gastric, or oral jejunal), as detailed more fully herein.

It has been reported that a GI dysbiosis is associated with diabetes (Qin et al., 2012. Nature 490:55). In some embodiments, a composition provided herein can be used to alter the microbiota of a subject having or susceptible diabetes. Typically, such a composition provides at least one, two, or three OTUs identified in the art as associated with an improvement in insulin sensitivity or other sign or symptom associated with diabetes, e.g., Type 2 or Type 1 diabetes. In some embodiments, the composition is associated with an increase in engraftment and/or augmentation of at least one, two, or three OTUs associated with an improvement in at least one sign or symptom of diabetes.

Pretreatment Protocols

Prior to administration of the bacterial composition, the subject may optionally have a pretreatment protocol to prepare the gastrointestinal tract to receive the bacterial composition. In certain embodiments, the pretreatment protocol is advisable, such as when a subject has an acute infection with a highly resilient pathogen. In other embodiments, the pretreatment protocol is entirely optional, such as when the pathogen causing the infection is not resilient, or the subject has had an acute infection that has been successfully treated but where the physician is concerned that the infection may recur. In these instances, the pretreatment protocol may enhance the ability of the bacterial composition to affect the subject's microbiome.

As one way of preparing the subject for administration of the microbial ecosystem, at least one antibiotic may be administered to alter the bacteria in the subject. As another way of preparing the subject for administration of the microbial ecosystem, a standard colon-cleansing preparation may be administered to the subject to substantially empty the contents of the colon, such as used to prepare a subject for a colonscopy. By "substantially emptying the contents of the colon," this application means removing at least 75%, at least 80%, at least 90%, at least 95%, or about 100% of the contents of the ordinary volume of colon contents. Antibiotic treatment may precede the colon-cleansing protocol.

If a subject has received an antibiotic for treatment of an infection, or if a subject has received an antibiotic as part of a specific pretreatment protocol, in one embodiment the antibiotic should be stopped in sufficient time to allow the antibiotic to be substantially reduced in concentration in the gut before the bacterial composition is administered. In one embodiment, the antibiotic may be discontinued 1, 2, or 3 days before the administration of the bacterial composition. In one embodiment, the antibiotic may be discontinued 3, 4, 5, 6, or 7 antibiotic half-lives before administration of the bacterial composition. In another embodiment, the antibiotic may be chosen so the constituents in the bacterial composition have an MIC50 that is higher than the concentration of the antibiotic in the gut.

MIC50 of a bacterial composition or the elements in the composition may be determined by methods well known in the art. Reller et al., Antimicrobial Susceptibility Testing: A Review of General Principles and Contemporary Practices, Clinical Infectious Diseases 49(11): 1 749-1755 (2009). In such an embodiment, the additional time between antibiotic administration and administration of the bacterial composition is not necessary. If the pretreatment protocol is part of treatment of an acute infection, the antibiotic may be chosen so that the infection is sensitive to the antibiotic, but the constituents in the bacterial composition are not sensitive to the antibiotic.

Routes of Administration

The bacterial compositions of the invention are suitable for administration to mammals and non-mammalian animals in need thereof. In certain embodiments, the mammalian subject is a human subject who has one or more symptoms of a dysbiosis.

When the mammalian subject is suffering from a disease, disorder or condition characterized by an aberrant microbiota, the bacterial compositions described herein are suitable for treatment thereof. In some embodiments, the mammalian subject has not received antibiotics in advance of treatment with the bacterial compositions. For example, the mammalian subject has not been administered at least two doses of vancomycin, metronidazole and/or or similar antibiotic compound within one week prior to administration of the therapeutic composition. In other embodiments, the mammalian subject has not previously received an antibiotic compound in the one month prior to administration of the therapeutic composition. In other embodiments, the mammalian subject has received one or more treatments with one or more different antibiotic compounds and such treatment(s) resulted in no improvement or a worsening of symptoms.

In some embodiments, the gastrointestinal disease, disorder or condition is diarrhea caused by C. difficile including recurrent C. difficile infection, ulcerative colitis, colitis, Crohn's disease, or irritable bowel disease. Beneficially, the therapeutic composition is administered only once prior to improvement of the disease, disorder or condition. In some embodiments the therapeutic composition is administered at intervals greater than two days, such as once every three, four, five or six days, or every week or less frequently than every week. Or the preparation may be administered intermittently according to a set schedule, e.g., once a day, once weekly, or once monthly, or when the subject relapses from the primary illness. In another embodiment, the preparation may be administered on a long-term basis to subjects who are at risk for infection with or who may be carriers of these pathogens, including subjects who will have an invasive medical procedure (such as surgery), who will be hospitalized, who live in a long-term care or rehabilitation facility, who are exposed to pathogens by virtue of their profession (livestock and animal processing workers), or who could be carriers of pathogens (including hospital workers such as physicians, nurses, and other health care professionals).

In embodiments, the bacterial composition is administered enterically. This preferentially includes oral administration, or by an oral or nasal tube (including nasogastric, nasojejunal, oral gastric, or oral jejunal). In other embodiments, administration includes rectal administration (including enema, suppository, or colonoscopy). The bacterial composition may be administered to at least one region of the gastrointestinal tract, including the mouth, esophagus, stomach, small intestine, large intestine, and rectum. In some embodiments it is administered to all regions of the gastrointestinal tract. The bacterial compositions may be administered orally in the form of medicaments such as powders, capsules, tablets, gels or liquids. The bacterial compositions may also be administered in gel or liquid form by the oral route or through a nasogastric tube, or by the rectal route in a gel or liquid form, by enema or instillation through a colonoscope or by a suppository.

If the composition is administered colonoscopically and, optionally, if the bacterial composition is administered by other rectal routes (such as an enema or suppository) or even if the subject has an oral administration, the subject may have a colon-cleansing preparation. The colon-cleansing preparation can facilitate proper use of the colonoscope or other administration devices, but even when it does not serve a mechanical purpose it can also maximize the proportion of the bacterial composition relative to the other organisms previously residing in the gastrointestinal tract of the subject. Any ordinarily acceptable colon-cleansing preparation may be used such as those typically provided when a subject undergoes a colonoscopy.

Dosages and Schedule for Administration

In some embodiments the bacteria and bacterial compositions are provided in a dosage form. In some embodiments the dosage form is designed for administration of at least one OTU or combination thereof disclosed herein, wherein the total amount of bacterial composition administered is selected from 0.1 ng to 10 g, 10 ng to 1 g, 100 ng to 0.1 g, 0.1 mg to 500 mg, 1 mg to 100 mg, or from 10-15 mg. In some embodiments the bacterial composition is consumed at a rate of from 0.1 ng to 10 g a day, 10 ng to 1 g a day, 100 ng to 0.1 g a day, 0.1 mg to 500 mg a day, 1 mg to 100 mg a day, or from 10-15 mg a day, or more.

In some embodiments the treatment period is at least 1 day, at least 2 days, at least 3 days, at least 4 days, at least 5 days, at least 6 days, at least 1 week, at least 2 weeks, at least 3 weeks, at least 4 weeks, at least 1 month, at least 2 months, at least 3 months, at least 4 months, at least 5 months, at least 6 months, or at least 1 year. In some embodiments the treatment period is from 1 day to 1 week, from 1 week to 4 weeks, from 1 month, to 3 months, from 3 months to 6 months, from 6 months to 1 year, or for over a year.

In one embodiment, from $10^5$ and $10^{12}$ microorganisms total may be administered to the subject in a given dosage form. In one mode, an effective amount may be provided in from 1 to 500 ml or from 1 to 500 grams of the bacterial composition having from $10^7$ to $10^{11}$ bacteria per ml or per gram, or a capsule, tablet or suppository having from 1 mg to 1000 mg lyophilized powder having from $10^7$ to $10^{11}$ bacteria. Those receiving acute treatment may receive higher doses than those who are receiving chronic administration (such as hospital workers or those admitted into long-term care facilities).

Any of the preparations described herein may be administered once on a single occasion or on multiple occasions, such as once a day for several days or more than once a day on the day of administration (including twice daily, three times daily, or up to five times daily). Or the preparation may be administered intermittently according to a set schedule, e.g., once weekly, once monthly, or when the subject relapses from the primary illness. In another embodiment, the preparation may be administered on a long-term basis to individuals who are at risk for infection with or who may be carriers of these pathogens, including individuals who will have an invasive medical procedure (such as surgery), who will be hospitalized, who live in a long-term care or rehabilitation facility, who are exposed to pathogens by virtue of their profession (livestock and animal processing workers), or who could be carriers of pathogens (including hospital workers such as physicians, nurses, and other health care professionals).

Subject Selection

Particular bacterial compositions may be selected for individual subjects or for subjects with particular profiles. For example, 16S sequencing may be performed for a given subject to identify the bacteria present in his or her microbiota. The sequencing may either profile the subject's entire microbiome using 16S sequencing (to the family, genera, or species level), a portion of the subject's microbiome using 16S sequencing, or it may be used to detect the presence or absence of specific candidate bacteria that are biomarkers for health or a particular disease state, such as markers of multi-drug resistant organisms or specific genera of concern such as *Escherichia*. Based on the biomarker data, a particular composition may be selected for administration to a subject to supplement or complement a subject's microbiota in order to restore health or treat or prevent disease. In another embodiment, subjects may be screened to determine the composition of their microbiota to determine the likelihood of successful treatment.

Combination Therapy

The bacterial compositions may be administered with other agents in a combination therapy mode, including anti-microbial agents and prebiotics. Administration may be sequential, over a period of hours or days, or simultaneous.

In one embodiment, the bacterial compositions are included in combination therapy with one or more anti-microbial agents, which include anti-bacterial agents, anti-fungal agents, anti-viral agents and anti-parasitic agents.

Anti-bacterial agents include cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); and carbapenem antibiotics (ertapenem, doripenem, imipenem/cilastatin, and meropenem).

Anti-viral agents include Abacavir, Acyclovir, Adefovir, Amprenavir, Atazanavir, Cidofovir, Darunavir, Delavirdine, Didanosine, Docosanol, Efavirenz, Elvitegravir, Emtricitabine, Enfuvirtide, Etravirine, Famciclovir, Foscarnet, Fomivirsen, Ganciclovir, Indinavir, Idoxuridine, Lamivudine, Lopinavir Maraviroc, MK-2048, Nelfinavir, Nevirapine, Penciclovir, Raltegravir, Rilpivirine, Ritonavir, Saquinavir, Stavudine, Tenofovir Trifluridine, Valaciclovir, Valganciclovir, Vidarabine, Ibacitabine, Amantadine, Oseltamivir, Rimantidine, Tipranavir, Zalcitabine, Zanamivir and Zidovudine.

Examples of antifungal compounds include, but are not limited to polyene antifungals such as natamycin, rimocidin, filipin, nystatin, amphotericin B, candicin, and hamycin; imidazole antifungals such as miconazole, ketoconazole, clotrimazole, econazole, omoconazole, bifonazole, butoconazole, fenticonazole, isoconazole, oxiconazole, sertaconazole, sulconazole, and tioconazole; triazole antifungals such as fluconazole, itraconazole, isavuconazole, ravuconazole, posaconazole, voriconazole, terconazole, and albaconazole; thiazole antifungals such as abafungin; allylamine antifungals such as terbinafine, naftifine, and butenafine; and echinocandin antifungals such as anidulafungin, caspofungin, and micafungin. Other compounds that have antifungal properties include, but are not limited to polygodial, benzoic acid, ciclopirox, tolnaftate, undecylenic acid, flucytosine or 5-fluorocytosine, griseofulvin, and haloprogin.

In one embodiment, the bacterial compositions are included in combination therapy with one or more corticosteroids, mesalazine, mesalamine, sulfasalazine, sulfasalazine derivatives, immunosuppressive drugs, cyclosporin A, mercaptopurine, azathiopurine, prednisone, methotrexate, antihistamines, glucocorticoids, epinephrine, theophylline, cromolyn sodium, anti-leukotrienes, anti-cholinergic drugs for rhinitis, anti-cholinergic decongestants, mast-cell stabilizers, monoclonal anti-IgE antibodies, vaccines, and combinations thereof.

A prebiotic is a selectively fermented ingredient that allows specific changes, both in the composition and/or activity in the gastrointestinal microbiota that confers benefits upon host well being and health. Prebiotics may include complex carbohydrates, amino acids, peptides, or other essential nutritional components for the survival of the bacterial composition. Prebiotics include, but are not limited to, amino acids, biotin, fructooligosaccharide, galactooligosaccharides, inulin, lactulose, mannan oligosaccharides, oligofructose-enriched inulin, oligofructose, oligodextrose, tagatose, trans-galactooligosaccharide, and xylooligosaccharides.

Methods for Characterization of Bacterial Compositions

In certain embodiments, provided are methods for testing certain characteristics of bacterial compositions. For example, the sensitivity of bacterial compositions to certain environmental variables is determined, e.g., in order to select for particular desirable characteristics in a given composition, formulation and/or use. For example, the constituents in the bacterial composition may be tested for pH resistance, bile acid resistance, and/or antibiotic sensitivity, either individually on a constituent-by-constituent basis or collectively as a bacterial composition comprised of multiple bacterial constituents (collectively referred to in this section as bacterial composition).

pH Sensitivity Testing. If a bacterial composition will be administered other than to the colon or rectum (i.e., through, for example, but not limited to, an oral route), optionally testing for pH resistance enhances the selection of bacterial compositions that will survive at the highest yield possible through the varying pH environments of the distinct regions of the GI tract. Understanding how the bacterial compositions react to the pH of the GI tract also assists in formulation, so that the number of bacteria in a dosage form can be increased if beneficial and/or so that the composition may be administered in an enteric-coated capsule or tablet or with a buffering or protective composition. As the pH of the stomach can drop to a pH of 1 to 2 after a high-protein meal for a short time before physiological mechanisms adjust it to a pH of 3 to 4 and often resides at a resting pH of 4 to 5, and as the pH of the small intestine can range from a pH of 6 to 7.4, bacterial compositions can be prepared that survive these varying pH ranges (specifically wherein at least 1%, 5%, 10%, 15%, 20%, 25%, 30%, 40%, 50%, 60%, 70%, 80%, 90%, or as much as 100% of the bacteria can survive gut transit times through various pH ranges). This may be tested by exposing the bacterial composition to varying pH ranges for the expected gut transit times through those pH ranges. Therefore, as a nonlimiting example only, 18-hour cultures of bacterial compositions may be grown in standard media, such as gut microbiota medium ("GMM", see Goodman et al., Extensive personal human gut microbiota culture collections characterized and manipulated in gnotobiotic mice, PNAS 108(15):6252-6257 (2011)) or another animal-products-free medium, with the addition of pH adjusting agents for a pH of 1 to 2 for 30 minutes, a pH of 3 to 4 for 1 hour, a pH of 4 to 5 for 1 to 2 hours, and a pH of 6 to 7.4 for 2.5 to 3 hours. An alternative method for testing stability to acid is described in U.S. Pat. No. 4,839,281. Survival of bacteria may be determined by culturing the bacteria and counting colonies on appropriate selective or non-selective media.

Bile Acid Sensitivity Testing. Additionally, in some embodiments, testing for bile-acid resistance enhances the selection of bacterial compositions that will survive exposures to bile acid during transit through the GI tract. Bile acids are secreted into the small intestine and can, like pH, affect the survival of bacterial compositions. This may be tested by exposing the bacterial compositions to bile acids for the expected gut exposure time to bile acids. For example, bile acid solutions may be prepared at desired concentrations using 0.05 mM Tris at pH 9 as the solvent. After the bile acid is dissolved, the pH of the solution may be adjusted to 7.2 with 10% HCl. Bacterial compositions may be cultured in 2.2 ml of a bile acid composition mimicking the concentration and type of bile acids in the subject, 1.0 ml of 10% sterile-filtered stool media and 0.1 ml of an 18-hour culture of the given strain of bacteria. Incubations may be conducted for from 2.5 to 3 hours or longer. An alternative method for testing stability to bile acid is described in U.S. Pat. No. 4,839,281. Survival of bacteria may be determined by culturing the bacteria and counting colonies on appropriate selective or non-selective media.

Antibiotic Sensitivity Testing. As a further optional sensitivity test, bacterial compositions may be tested for sensitivity to antibiotics. In one embodiment, bacterial compositions may be chosen so that the bacterial constituents are sensitive to antibiotics such that if necessary they can be eliminated or substantially reduced from the subject's gastrointestinal tract by at least one antibiotic targeting the bacterial composition.

Adherence to Gastrointestinal Cells. The bacterial compositions may optionally be tested for the ability to adhere to gastrointestinal cells. A method for testing adherence to gastrointestinal cells is described in U.S. Pat. No. 4,839,281.

The specification is most thoroughly understood in light of the teachings of the references cited within the specification. The embodiments within the specification provide an illustration of embodiments and should not be construed to limit the scope. The skilled artisan readily recognizes that many other embodiments are encompassed. All publications and patents cited in this disclosure are incorporated by reference in their entirety. To the extent the material incorporated by reference contradicts or is inconsistent with this specification, the specification will supersede any such material. The citation of any references herein is not an admission that such references are prior art.

Unless otherwise indicated, all numbers expressing quantities of ingredients, reaction conditions, and so forth used in the specification, including claims, are to be understood as being modified in all instances by the term "about." Accordingly, unless otherwise indicated to the contrary, the numerical parameters are approximations and may vary depending upon the desired properties sought to be obtained. At the very least, and not as an attempt to limit the application of the doctrine of equivalents to the scope of the claims, each numerical parameter should be construed in light of the number of significant digits and ordinary rounding approaches.

Unless otherwise indicated, the term "at least" preceding a series of elements is to be understood to refer to every element in the series.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for. Examples of the techniques and protocols described herein with regard to therapeutic compositions can be found in, e.g., Remington's Pharmaceutical Sciences, 16th edition, Osol, A. (ed), 1980.

Example 1. Construction of Binary Pairs in a High-Throughput 96-Well Format/Plate Preparation Pairs of bacteria were used to identify binary pairs useful for inhibition of *C. difficile*. To prepare plates for the high-throughput screening assay of binary pairs, vials of −80° C. glycerol stock bacterial banks were thawed and diluted to 1e8 CFU/mL. Each bacterial strain was then diluted 10× (to a final concentration of 1e7 CFU/mL of each strain) into 200 uL of PBS+15% glycerol in the wells of a 96-well plate. Plates were then frozen at −80° C. When needed, plates were removed from −80° C. and thawed at room temperature under anaerobic conditions for testing in a CivSim assay with *C. difficile*.

Example 2. Construction of Ternary Combinations in a High-Throughput 96-Well Format Triplet combinations of bacteria were used to identify ternary combinations useful for inhibition of *C. difficile*. To prepare plates for high-throughput screening of ternary combinations, vials of −80° C. glycerol bacterial stock banks were thawed and diluted to 1e8 CFU/mL. Each bacterial strain was then diluted 10× (to a final concentration of 1e7 CFU/mL of each strain) into 200 uL of PBS+15% glycerol in the wells of a 96-well plate. Plates were then frozen at −80° C. When needed for the assay, plates were removed from −80° C. and thawed at room temperature under anaerobic conditions when testing in a CivSim assay with *Clostridium difficile*.

Example 3. Construction of a CivSim Assay to Screen for Bacterial Compositions Inhibitory to the Growth of *Clostridium difficile*

A competition assay (CivSim assay) was used to identify compositions that can inhibit the growth of *C. difficile*. Briefly, an overnight culture of *C. difficile* was grown under anaerobic conditions in SweetB-FosIn for the growth of *C. difficile*. In some cases, other suitable media can be used. SweetB-FosIn is a version of BHI (Remel R452472) supplemented with several components as follows: Components per liter: 37 g BHI powder (Remel R452472), supplemented with 5 g yeast extract UF (Difco 210929), 1 g cysteine-HCl (Spectrum C1473), 1 g cellobiose (Sigma C7252), 1 g maltose (Spectrum MA155), 1.5 ml hemin solution, 1 g soluble starch (Sigma-Aldrich S9765), 1 g fructooligosaccharides/inulin (Jarrow Formulas 103025) and 50 mL 1 M MOPS/KOH pH 7. To prepare the hemin solution, hemin (Sigma 51280) was dissolved in 0.1 M NaOH to make a 10 mg/mL stock.

After 24 hours of growth the culture was diluted 100,000 fold into a complex medium SweetB-FosIn. In some embodiments a medium is selected for use in which all desired organisms can grow, i.e., which is suitable for the growth of a wide variety of anaerobic, and, in some cases facultative anaerobic bacterial species. The diluted *C. difficile* mixture was then aliquoted to wells of a 96-well plate (180 uL to each well). 20 uL of a bacterial composition was then added to each well at a final concentration of 1e6 CFU/mL of each or two or three species. Alternatively the assay can be tested with binary pairs at different initial concentrations (1c9 CFU/mL, 1e8 CFU/mL, 1e7 CFU/mL, 1e5 CFU/mL, 1e4 CFU/mL, 1e3 CFU/mL, 1e2 CFU/mL). Control wells only inoculated with *C. difficile* were included for a comparison to the growth of *C. difficile* without inhibition. Additional wells were used for controls that either inhibit or do not inhibit the growth of *C. difficile*. One example of a positive control that inhibits growth was a combination of *Blautia producta, Clostridium bifermentans* and *Escherichia coli*. One example of a control that shows reduced inhibition of *C. difficile* growth as a combination of *Bacteroides thetaiotaomicron, Bacteroides ovatus* and *Bacteroides vulgatus*. Plates were wrapped with parafilm and incubated for 24 hours at 37° C. under anaerobic conditions. After 24 hours, the wells containing *C. difficile* alone were serially diluted and plated to determine titer. The 96-well plate was then frozen at −80 C before quantifying *C. difficile* by qPCR assay (see Example 6). Experimental combinations that inhibit *C. difficile* in this assay are useful in compositions for prevention or treatment of *C. difficile* infection.

Example 4. Construction of a CivSim Assay to Screen for Bacterial Compositions that Produce Diffusible Products Inhibitory to the Growth of *Clostridium difficile* Using a Filter Insert To identify bacterial compositions that can produce diffusible products that inhibit *C. difficile* a modified CivSim assay was designed. In this experiment, the CivSim assay described above was modified by using a 0.22 uM filter insert (Millipore™ MultiScreen™ 96-Well Assay Plates—Item MAGVS2210) in 96-well format to physically separate *C. difficile* from the bacterial compositions. The *C. difficile* was aliquoted into the 96-well plate while the bacterial compositions were aliquoted into media on the filter overlay. The nutrient/growth medium is in contact on both sides of the 0.22 uM filter, allowing exchange of nutrients, small molecules and many macromolecules (e.g., bacteriocins, cell-surface proteins, or polysaccharides) by diffusion. In this embodiment, after a 24 hour incubation, the filter insert containing the bacterial compositions was removed. The plate containing *C. difficile* was then transferred to a 96-well plate reader suitable for measuring optical density (OD) at 600 nm. The growth of *C. difficile* in the presence of different bacterial compositions was compared based on the OD measurement. The results of these experiments demonstrated that compositions that can inhibit *C. difficile* when grown in shared medium under conditions that do not permit contact between the bacteria in the composition and *C. difficile* can be identified. Such compositions are candidates for producing diffusible products that are effective for treating *C. difficile* infection and can serve as part of a process for isolating such diffusible products, e.g., for use in treating infection.

Example 5. Construction of a CivSim Assay to Screen for Bacterial Compositions Inhibitory to the Growth of *Clostridium difficile* Using *Clostridium difficile* Selective Media for Quantification The CivSim assay described above can be modified to determine final *C. difficile* titer by serially diluting and plating to *C. difficile* selective media (Bloedt et al. 2009) such as CCFA (cycloserine cefoxitin fructose agar, Anaerobe Systems), CDSA (*Clostridium difficile* selective agar, which is cycloserine cefoxitin mannitol agar, Becton Dickinson).

Example 6. Quantification of *C. difficile* Using Quantitative PCR (qPCR)

A. Standard Curve Preparation

To quantitate *C. difficile*, a standard curve was generated from a well on each assay plate in, e.g., a CivSim assay, containing only pathogenic *C. difficile* grown in SweetB+FosIn media as provided herein and quantified by selective spot plating. Serial dilutions of the culture were performed in sterile phosphate-buffered saline. Genomic DNA was extracted from the standard curve samples along with the other wells.

B. Genomic DNA Extraction

Genomic DNA was extracted from 5 μl of each sample using a dilution, freeze/thaw, and heat lysis protocol. 5 μL of thawed samples were added to 45 μL of UltraPure water (Life Technologies, Carlsbad, Calif.) and mixed by pipetting. The plates with diluted samples were frozen at −20° C. until use for qPCR which included a heated lysis step prior to amplification. Alternatively the genomic DNA could be isolated using the Mo Bio Powersoil®-htp 96 Well Soil DNA Isolation Kit (Mo Bio Laboratories, Carlsbad, Calif.), Mo Bio Powersoil® DNA Isolation Kit (Mo Bio Laboratories, Carlsbad, Calif.), or the QIAamp DNA Stool Mini Kit (QIAGEN, Valencia, Calif.) according to the manufacturer's instructions.

C. qPCR Composition and Conditions

The qPCR reaction mixture contained 1× SsoAdvanced Universal Probes Supermix, 900 nM of Wr-tcdB-F primer (AGCAGTTGAATATAGTGGTTTAGTTAGAGTTG (SEQ ID NO: 2033), IDT, Coralville, Iowa), 900 nM of Wr-tcdB-R primer (CATGCTTTTTTAGTTTCTGGATTGAA (SEQ ID NO: 2034), MT, Coralville, Iowa), 250 nM of Wr-tcdB-P probe (6FAM-CATCCAGTCTCAATTGTATAT-GTTTCTCCA (SEQ ID NO: 2035)-MGB, Life Technologies, Grand Island, N.Y.), and Molecular Biology Grade Water (Mo Bio Laboratories, Carlsbad, Calif.) to 18 µl (Primers adapted from: Wroblewski, D. et al., Rapid Molecular Characterization of *Clostridium difficile* and Assessment of Populations of *C. difficile* in Stool Specimens, Journal of Clinical Microbiology 47:2142-2148 (2009)). This reaction mixture was aliquoted to wells of a Hard-shell Low-Profile Thin Wall 96-well Skirted PCR Plate (BioRad, Hercules, Calif.). To this reaction mixture, 2 µl of diluted, frozen, and thawed samples were added and the plate sealed with a Microseal 'B' Adhesive Seal (BioRad, Hercules, Calif.). The qPCR was performed on a BioRad C1000™ Thermal Cycler equipped with a CFX96™ Real-Time System (BioRad, Hercules, Calif.). The thermocycling conditions were 95° C. for 15 minutes followed by 45 cycles of 95° C. for 5 seconds, 60° C. for 30 seconds, and fluorescent readings of the FAM channel. Alternatively, the qPCR could be performed with other standard methods known to those skilled in the art.

D. Data Analysis

The Cq value for each well on the FAM channel was determined by the CFX Manager™ 3.0 software. The $\log_{10}$ (cfu/mL) of *C. difficile* each experimental sample was calculated by inputting a given sample's Cq value into a linear regression model generated from the standard curve comparing the Cq values of the standard curve wells to the known $\log_{10}$ (cfu/mL) of those samples. The log inhibition was calculated for each sample by subtracting the $\log_{10}$ (cfu/mL) of *C. difficile* in the sample from the $\log_{10}$ (cfu/mL) of *C. difficile* in the sample on each assay plate used for the generation of the standard curve that has no additional bacteria added. The mean log inhibition was calculated for all replicates for each composition.

A histogram of the range and standard deviation of each composition was plotted. Ranges or standard deviations of the log inhibitions that were distinct from the overall distribution were examined as possible outliers. If the removal of a single log inhibition datum from one of the binary pairs that were identified in the histograms would bring the range or standard deviation in line with those from the majority of the samples, that datum was removed as an outlier, and the mean log inhibition was recalculated.

The pooled variance of all samples evaluated in the assay was estimated as the average of the sample variances weighted by the sample's degrees of freedom. The pooled standard error was then calculated as the square root of the pooled variance divided by the square root of the number of samples. Confidence intervals for the null hypothesis were determined by multiplying the pooled standard error to the z score corresponding to a given percentage threshold. Mean log inhibitions outside the confidence interval were considered to be inhibitory if positive or stimulatory if negative with the percent confidence corresponding to the interval used. Samples with mean log inhibition greater than the 99% confidence interval (C.I) of the null hypothesis are reported as ++++, those with a 95%<C.I.<99% as +++, those with a 90%<C.I.<95% as ++, those with a 80%<C.I.<90% as + while samples with mean log inhibition less than the 99% confidence interval (C.I) of the null hypothesis are reported as ----, those with a 95%<C.I.<99% as ---, those with a 90%<C.I.<95% as --, those with a 80%<C.I.<90% as -.

Example 7. Inhibition of *C. difficile* Growth by Bacterial Compositions

Using methods described herein, binary pairs were identified that can inhibit *C. difficile* (see Table 4). 622 of 989 combinations showed inhibition with a confidence interval >80%; 545 of 989 with a C.I.>90%; 507 of 989 with a C.I.>95%; 430 of 989 with a C.I. of >99%. Non-limiting but exemplary binary pairs include those with mean log reduction greater than 0.366, e.g., *Allistipes shahii* paired with *Blautia producta*, *Clostridium hathaweyi*, or *Collinsella aerofaciens*, or *Clostridium mayombei* paired with *C. innocuum*. *C. tertium*, *Collinsella aerofaciens*, or any of the other 424 combinations shown in Table 4. Equally important, the CivSim assay describes binary pairs that do not effectively inhibit *C. difficile*. 188 of 989 combinations promote growth with >80% confidence; 52 of 989 show a lack of inhibition with >90% confidence; 22 of 989 show a lack of inhibition with >95% confidence; 3 of 989, including *B. producta* combined with *Coprococcus catus*, *Alistipes shahii* combined with *Dorea formicigenerans*, and *Eubacterium rectale* combined with *Roseburia intestinalis*, show a lack of inhibition with >99% confidence. 249 of 989 combinations are neutral in the assay, meaning they neither promote nor inhibit *C. difficile* growth to the limit of measurement.

Ternary combinations with mean log inhibition greater than the 99% confidence interval (C.I) of the null hypothesis are reported as ++++, those with a 95%<C.I.<99% as +++, those with a 90%<C.I.<95% as ++, those with a 80%<C.I.<90% as + while samples with mean log inhibition less than the 99% confidence interval (C.I) of the null hypothesis are reported as ----, those with a 95%<C.I.<99% as ---, those with a 90%<C.I.<95% as --, those with a 80%<C.I.<90% as -.

The CivSim assay results demonstrate that many ternary combinations can inhibit *C. difficile* (Table 4). 516 of 632 ternary combinations show inhibition with a confidence interval >80%; 507 of 632 with a C.I.>90%; 496 of 632 with a C.I.>95%; 469 of 632 with a C.I. of >99%. Non-limiting but exemplary ternary combinations include those with a score of ++++, such as *Colinsella aerofaciens*, *Coprococcus comes*, and *Blautia producta*. The CivSim assay also describes ternary combinations that do not effectively inhibit *C. difficile*. 76 of 632 combinations promote growth with >80% confidence; 67 of 632 promote growth with >90% confidence; 61 of 632, promote growth with >95% confidence; and 49 of 632 combinations such as, but not limited to, *Clostridium orbiscendens*, *Coprococcus comes*, and *Faecalibacterium prausnitzii* promote growth with >99% confidence. 40 of 632 combinations are neutral in the assay, meaning they neither promote nor inhibit *C. difficile* growth to the limit of confidence.

Of the ternary combinations that inhibit *C. difficile* with >99% confidence, those that strongly inhibit *C. difficile* can be identified by comparing their mean log inhibition to the distribution of all results for all ternary combinations tested. Those above the 75th percentile can be considered to strongly inhibit *C. difficile*. Alternatively, those above the 50th, 60th, 70th, 80th, 90th, 95th, or 99th percentile can be considered to strongly inhibit *C. difficile*. Non-limiting but exemplary ternary combinations above the 75th percentile include *Blautia producta*, *Clostridium tertium*, and *Ruminococcus gnavus* and *Eubacterium rectale*, *Clostridium mayombei*, and *Ruminococcus bromii*.

In addition to the demonstration that many binary and ternary combinations inhibit *C. difficile*, the CivSim demonstrates that many of these combinations synergistically inhibit *C. difficile*. Exemplary ternary combinations that demonstrate synergy in the inhibition of *C. difficile* growth include, but are not limited to, *Blautia producta*, *Clostridium innocuum*, *Clostridium orbiscendens* and *Colinsella aerofa-*

*ciens, Blautia producta*, and *Eubacterium rectale*. Additional useful combinations are provided throughout, e.g., in Tables 4a, 4b, and 14-21.

Two higher-order bacterial compositions were tested in the CivSim assay for inhibition of *C. difficile*. N1962 (a.k.a. S030 and N1952), a 15 member composition, inhibited *C. difficile* by an average of 2.73 log 10 CFU/mL with a standard deviation of 0.58 log 10 CFU/mL while N1984 (a.k.a. S075), a 9 member composition, inhibited *C. difficile* by an average of 1.42 log 10 CFU/mL with a standard deviation of 0.45 log 10 CFU/mL.

These data collectively demonstrate that the CivSim assay can be used to identify compositions containing multiple species that are effective at inhibiting growth, that promote growth, or do not have an effect on growth of an organism, e.g., a pathogenic organism such as *C. difficile*.

Example 8. In Vivo Validation of Ternary Combinations' Efficacy in a Murine Model of *Clostridium difficile* Infection To test the therapeutic potential of a bacterial composition such as but not limited to a spore population, a prophylactic mouse model of *C. difficile* infection was used (model based on Chen et al., 2008. A mouse model of *Clostridium difficile*-associated disease. Gastroenterology 135: 1984-1992). Briefly, two cages of five mice each were tested for each arm of the experiment. All mice received an antibiotic cocktail consisting of 10% glucose, kanamycin (0.5 mg/ml), gentamicin (0.044 mg/ml), colistin (1062.5 U/ml), metronidazole (0.269 mg/ml), ciprofloxacin (0.156 mg/ml), ampicillin (0.1 mg/ml) and vancomycin (0.056 mg/ml) in their drinking water on days −14 through −5 and a dose of 10 mg/kg clindamycin by oral gavage on day −3. On day −1, test compositions were spun for 5 minutes at 12,100 rcf, their supernatants' removed, and the remaining pellets were resuspended in sterile PBS, prereduced if bacterial composition was not in spore form, and delivered via oral gavage. On day 0 the mice were challenged by administration of approximately 4.5 log 10 cfu of *C. difficile* (ATCC 43255) or sterile PBS (for the naive arm) via oral gavage. Mortality, weight and clinical scoring of *C. difficile* symptoms based upon a 0-4 scale by combining scores for appearance (0-2 points based on normal, hunched, piloerection, or lethargic), and clinical signs (0-2 points based on normal, wet tail, cold-to-the-touch, or isolation from other animals), with a score of 4 in the case of death, were assessed every day from day −2 through day 6. Mean minimum weight relative to day −1 and mean maximum clinical score as well as average cumulative mortality were calculated. Reduced mortality, increased mean minimum weight relative to day −1, and reduced mean maximum clinical score with death assigned to a score of 4 relative to the vehicle control were used to assess the ability of the test composition to inhibit infection by *C. difficile*.

Ternary combinations were tested in the murine model described above at 1e9 CFU/mL per strain. The results are shown in Table 5. The data demonstrate that the CivSim assay results are highly predictive of the ability of a combination to inhibit weight loss in *C. difficile* infection. Weight loss in this model is generally considered to be indicative of disease.

In one embodiment, compositions to screen for efficacy in vivo can be selected by ranking the compositions based on a functional metric such as but not limited to in vitro growth inhibition scores; compositions that are ranked ≥the 75th percentile can be considered to strongly inhibit growth and be selected for in vivo validation of the functional phenotype. In other embodiments, compositions above the 50th, 60th, 70th, 80th, 90th, 95th, or 99th percentile can be considered to be the optimal candidates. In another embodiment, combinations with mean log inhibition greater than the 99% confidence interval (C.I) of the null hypothesis are selected. In other embodiments, compositions greater than the 95%, 90%, 85%, or 80% confidence interval (C.I.) are selected. In another embodiment, compositions demonstrated to have synergistic inhibition are selected (see Example 7) for testing in an in vivo model such as that described above.

Compositions selected to screen for efficacy in in vivo models can also be selected using a combination of growth inhibition metrics. In a non-limiting example: (i) compositions are selected based on their log inhibition being greater than the 99% confidence interval (C.I.) of the null hypothesis, (ii) the selected subset of compositions is further selected to represent those that are ranked ≥the 75th percentile in the distribution of all inhibition scores, (iii) the subset of (ii) is then further selected based on compositions that demonstrate synergistic inhibition. In some embodiments, different confidence intervals (C.I.) and percentiles are used to create the composition subsets, e.g., see Table 4b.

Of the twelve exemplary ternary combinations selected, all were demonstrated to inhibit *C. difficile* in the CivSim assay (see Example 6) with >99% confidence. Ten of the twelve compositions demonstrated a protective effect when compared to a vehicle control with respect to the Mean Minimum Relative Weight. All twelve compositions outperformed vehicle with respect to Mean Maximum Clinical Score while eleven of twelve compositions surpassed the vehicle control by Cumulative Mortality. A non-limiting, but exemplary ternary combination, *Collinsella aerofaciens, Clostridium buytricum*, and *Ruminococcus gnavus*, was protective against symptoms of *C. difficile* infection, producing a Mean Minimum Relative Weight of 0.96, a Mean Maximum Clinical Score of 0.2, and Cumulative Mortality of 0% compared to the vehicle control of 0.82, 2.6, and 30%, respectively. These results demonstrate that the in vitro CivSim assay can be used to identify compositions that are protective in an in vivo murine model. This is surprising given the inherent dynamic nature of in vivo biological systems and the inherent simplification of the in vitro assays; it would not be expected that there is a direct correlation of in vitro in vivo measures of inhibition and efficacy. This is in part because of the complexity of the in vivo system into which a composition is administered for treatment in which it might have been expected that confounding factors would obscure or affect the ability of a composition deemed effective in vitro to be effective in vivo.

Example 9. Construction of a CivSim Assay to Screen for Bacterial Compositions Inhibitory to the Growth of Vancomycin-Resistant *Enterococcus* (VRE) Using Vancomycin-Resistant *Enterococcus* Selective Medium for Quantification and Composition Screening To determine the ability of a composition to compete with a pathogenic bacterium, e.g., vancomycin-resistant *Enterococcus*, a competition assay was developed. In these experiments, an overnight culture of a vancomycin-resistant strain of *Enterococcus faecium* was grown anaerobically in SweetB-FosIn for 24 hours. A glycerol stock of a bacterial composition was thawed from −80° C. and diluted to 1e6 CFU/mL per strain in SweetB-FosIn in the appropriate wells of a 96-well plate. The plate was incubated anaerobically at 37° C. for 1 hour to allow the previously frozen bacteria to revive. After the 1 hour initial incubation, VRE was inoculated into appropriate wells at target concentrations of 1e2 or 1e3 CFU/mL. Wells were also inoculated with VRE alone, without a bacterial composition. The plate was incubated anaerobically at 37° C. for 24 hours. Aliquots were removed at 15 hours and 24 hours and the VRE titers determined. At each time-point, well contents were serially diluted and plated to agar plates selective for VRE (Enterococcosel Agar+ 8 ug/mL vancomycin hydrochloride) (Enterococcosel Agar from BBL 212205, vancomycin hydrochloride from Sigma 94747). The selective plates were incubated aerobically at 37° C. for 24 hours before counting colonies to determine final titer of VRE in each well of the CivSim plate. Log Inhibition of VRE was determined by subtracting the final titer of a competition well from the final titer of a well containing VRE alone. Multiple ratios of the starting concentrations of VRE and bacterial compositions were tested to optimize for conditions resulting in the greatest signal. A competition time of 15 hours, a starting concentration of VRE at 1e2 CFU/mL and a starting concentration of N1962 (a.k.a. S030 and N1952) at 1e6 CFU/mL showed the greatest inhibition of growth compared to control.

Using the conditions described above, one 15-member and 44 heterotrimeric bacterial compositions were tested in the assay, the results of which are provided in Tables 4 and 6. Of the 44 heterotrimeric compositions tested, 43 inhibited VRE with >80% confidence, 41 inhibited VRE with >95% confidence, and 39 inhibited VRE with >99% confidence. One ternary composition tested did not demonstrate inhibition or induction with >80% confidence.

Of the ternary combinations that inhibit VRE with >99% confidence, those that strongly inhibit VRE can be identified by comparing their mean log inhibition to the distribution of all results for all ternary combinations tested. Those above the 75th percentile can be considered to strongly inhibit VRE. Alternatively, those above the 50th, 60th, 70th, 80th, 90th, 95th, or 99th percentile can be considered to strongly inhibit VRE. Non-limiting but exemplary ternary combinations that inhibit VRE with >99% confidence and above the 75th percentile include *Blautia producia, Clostridium innocuum,* and *Ruminococcus gnavus* and *Blautia producta, Clostridium bulyricum,* and *Clostridium hylemonae.*

The 15-member composition, N1962 (a.k.a. S030 and N1952), inhibited VRE by at least 0.7 log 10 CFU/mL across all of the conditions tested and demonstrating inhibition of 5.7 log 10 CFU/mL in the optimal conditions.

These data demonstrate methods of identifying compositions useful for prophylaxis and treatment of VRE infection.

Example 10. Construction of a CivSim Assay to Screen for Bacterial Compositions Inhibitory to the Growth of *Klebsiella pneumoniae* Using *Klebsiella* Selective Medium for Quantification To determine the ability of a composition to compete with a pathogenic bacterium, e.g., *Klebsiella pneumoniae,* a competition assay was developed. In these experiments, an overnight culture of a vancomycin-resistant strain of *Klebsiella pneumoniae* was grown anaerobically in SweetB-FosIn for 24 hours. A glycerol stock of a bacterial composition (NI 962) was thawed from −80° C. and diluted to 1e6 CFU/mL per strain in SweetB-FosIn in the appropriate wells of a 96-well plate. The plate was incubated anaerobically at 37° C. for 1 hour to allow the previously frozen bacteria to revive. After the 1 hour initial incubation, *K. pneumoniae* was inoculated into appropriate wells at target concentrations of 1e2 or 1e3 CFU/mL. Wells were also inoculated with *K. pneumoniae* alone, without a bacterial composition. The plate was incubated anaerobically at 37° C. for 24 hours. Aliquots were removed at 15 hours and 24 hours to titer for the final concentration of *K. pneumoniae* at the end of competition. At each time-point, wells were serially diluted and plated to agar plates selective for *K. pneumoniae* (MacConkey Lactose Agar, Teknova M0149). The selective plates were incubated aerobically at 37° C. for 24 hours before counting colonies to determine final titer of *K. pneumoniae* in each well of the CivSim plate. Log Inhibition of *K. pneumoniae* was determined by subtracting the final titer of a competition well from the final titer of a well containing *K. pneumoniae* alone. Multiple ratios of the starting concentrations of *K. pneumoniae* and bacterial compositions were tested to optimize for conditions giving the greatest signal. The results of the assay are provided in Table 7. A competition time of 15 hours, a starting concentration of *K. pneumoniae* at 1e2 CFU/mL and a starting concentration of N1962 (a.k.a. S030 and N1952) at 1e6 CFU/mL showed the greatest inhibition of growth compared to control. N1962 (a.k.a. S030 and N1952) inhibited *K. pneumoniae* by 0.1-4.2 log 10 CFU/mL across the conditions tested.

Example 11. Construction of a CivSim Assay to Screen for Bacterial Compositions Inhibitory to the Growth of *Morganella morganii* Using *Morganella* Selective Media for Quantification To determine the ability of a composition to compete with a pathogenic bacterium, e.g., *Morganella morganii,* a competition assay was developed. In this experiment, an overnight culture of a vancomycin-resistant strain of *Morganella morganii* was grown anaerobically in SweetB-FosIn for 24 hours. A glycerol stock of a bacterial composition, N1962, was thawed from −80° C. and diluted to 1e6 CFU/mL per strain in SweetB-FosIn in the appropriate wells of a 96-well plate. The plate was incubated anaerobically at 37° C. for 1 hour to allow the previously frozen bacteria to revive. After the 1 hour initial incubation, *M. morganii* was inoculated into appropriate wells at target concentrations of 1e2 or 1e3 CFU/mL. Wells were also inoculated with *M. morganii* alone, without a bacterial composition. The plate was incubated anaerobically at 37° C. for 24 hours. Aliquots were removed at 15 hours and 24 hours to titer for the final concentration of *M. morganii* at the end of competition. At each time-point, wells were serially diluted and plated to agar plates selective for *M. morganii* (MacConkey Lactose Agar, Teknova M0149). The selective plates were incubated aerobically at 37° C. for 24 hours before counting colonies to determine final titer of *M. morganii* in each well of the CivSim plate. Log Inhibition of *M. morganii* was determined by subtracting the final titer of a competition well from the final titer of a well containing *M. morganii* alone. Multiple ratios of the starting concentrations of *M. morganii* and bacterial compositions were tested to optimize for conditions providing the greatest signal. A competition time of 15 hours, a starting concentration of *M. morganii* at 1e2 CFU/mL and a starting concentration of N1962 (a.k.a. S030 and N1952) at 1e6 CFU/mL showed the greatest inhibition of growth compared to control.

A 15-member bacterial composition, N1962 (a.k.a. S030 and N1952), was tested in the assay, the results of which are provided in Table 8. N1962 (a.k.a. S030 and N1952) inhibited *M. morganii* by 1.4 to 5.8 log 10 CFU/mL across the conditions tested.

Example 12. Sequence-Based Genomic Characterization of Operational Taxonomic Units (OTU) and Functional Genes Method for Determining 16S rDNA Gene Sequence As described above, OTUs are defined either by full 16S sequencing of the rDNA gene, by sequencing of a specific hypervariable region of this gene (i.e., V1, V2, V3, V4, V5, V6, V7, V8, or V9), or by sequencing of any combination of hypervariable regions from this gene (e.g., V1-3 or V3-5). The bacterial 16S rDNA gene is approximately 1500 nucleotides in length and is used in reconstructing the evolutionary relationships and sequence similarity of one bacterial isolate to another using phylogenetic approaches. 16S sequences are used for phylogenetic reconstruction as they are in general highly conserved, but contain specific hypervariable regions that harbor sufficient nucleotide diversity to differentiate genera and species of most microbes. rDNA gene sequencing methods are applicable to both the analysis of non-enriched samples, but also for identification of microbes after enrichment steps that either enrich the microbes of interest from a microbial composition or a microbial sample and/or the nucleic acids that harbor the appropriate rDNA gene sequences as described below. For example, enrichment treatments prior to 16S rDNA gene characterization will increase the sensitivity of 16S as well as other molecular-based characterization nucleic acid purified from the microbes.

Using techniques known in the art, to determine the full 16S sequence or the sequence of any hypervariable region of the 16S rDNA sequence, genomic DNA is extracted from a bacterial sample, the 16S rDNA (full region or specific hypervariable regions) amplified using polymerase chain reaction (PCR), the PCR products cleaned, and nucleotide sequences delineated to determine the genetic composition of 16S gene or subdomain of the gene. If full 16S sequencing is performed, the sequencing method used may be, but is not limited to, Sanger sequencing. If one or more hypervariable regions are used, such as the V4 region, the sequencing may be, but is not limited to being, performed using the Sanger method or using a next-generation sequencing method, such as an Illumina (sequencing by synthesis) method using barcoded primers allowing for multiplex reactions.

Method for Determining 18S rDNA and ITS Gene Sequence

Methods to assign and identify fungal OTUs by genetic means can be accomplished by analyzing 18S sequences and the internal transcribed spacer (ITS). The rRNA of fungi that forms the core of the ribosome is transcribed as a single gene and consists of the 8S, 5.8S and 28S regions with ITS4 and 5 between the 8S and 5.8S and 5.8S and 28S regions, respectively. These two intercistronic segments between the 18S and 5.8S and 5.8S and 28S regions are removed by splicing and contain significant variation between species for barcoding purposes as previously described (Schoch et al. Nuclear ribosomal internal transcribed spacer (ITS) region as a universal DNA barcode marker for Fungi. PNAS USA 109:6241-6246. 2012). 18S rDNA is typically used for phylogenetic reconstruction however the ITS can serve this function as it is generally highly conserved but contains hypervariable regions that harbor sufficient nucleotide diversity to differentiate genera and species of most fungus.

Using techniques known in the art, to determine the full 18S and ITS sequences or a smaller hypervariable section of these sequences, genomic DNA is extracted from a microbial sample, the rDNA amplified using polymerase chain reaction (PCR), the PCR products cleaned, and nucleotide sequences delineated to determine the genetic composition rDNA gene or subdomain of the gene. The sequencing method used may be, but is not limited to. Sanger sequencing or using a next-generation sequencing method, such as an Illumina (sequencing by synthesis) method using barcoded primers allowing for multiplex reactions.

Method for Determining Other Marker Gene Sequences

In addition to the 16S and 18S rDNA gene, an OTU can be defined by sequencing a selected set of genes or portions of genes that are known marker genes for a given species or taxonomic group of OTUs. These genes may alternatively be assayed using a PCR-based screening strategy. For example, various strains of pathogenic *Escherichia coli* can be distinguished using DNAs from the genes that encode heat-labile (LTI, LTIIa, and LTIIb) and heat-stable (STI and STII) toxins, verotoxin types 1, 2, and 2e (VT1, VT2, and VT2e, respectively), cytotoxic necrotizing factors (CNF1 and CNF2), attaching and effacing mechanisms (eaeA), enteroaggregative mechanisms (Eagg), and enteroinvasive mechanisms (Einv). The optimal genes to utilize for taxonomic assignment of OTUs by use of marker genes will be familiar to one with ordinary skill in the art of sequence based taxonomic identification.

Genomic DNA Extraction

Genomic DNA can be extracted from pure or enriched microbial cultures using a hot alkaline lysis method. For example, 1 µl of microbial culture is added to 9 µl of Lysis Buffer (25 mM NaOH, 0.2 mM EDTA) and the mixture is incubated at 95° C. for 30 minutes. Subsequently, the samples are cooled to 4° C. and neutralized by the addition of 10 µl of Neutralization Buffer (40 mM Tris-HCl) and then diluted 10-fold in Elution Buffer (10 mM Tris-HCl). Alternatively, genomic DNA is extracted from pure or enriched microbial cultures using commercially available kits such as the Mo Bio Ultraclean® Microbial DNA Isolation Kit (Mo Bio Laboratories, Carlsbad, Calif.) or by methods known to those skilled in the art. For fungal samples, DNA extraction can be performed by methods described previously (e.g., see US20120135127) for producing lysates from fungal fruiting bodies by mechanical grinding methods.

Amplification of 16S Sequences for Downstream Sanger Sequencing

To amplify bacterial 16S rDNA (e.g., in FIG. 2 and FIG. 3), 2 µl of extracted gDNA is added to a 20 µl final volume PCR reaction. For full-length 16 sequencing the PCR reaction also contains 1× HotMaster® Mix (5PRIME, Gaithersburg, Md.), 250 nM of 27f (AGRGTTTGATCMTG-GCTCAG (SEQ ID NO: 2036), IDT, Coralville, Iowa), and 250 nM of 1492r (TACGGYTACCTTGTTAYGACTT (SEQ ID NO: 2037), IDT, Coralville, Iowa), with PCR Water (Mo Bio Laboratories, Carlsbad, Calif.) for the balance of the volume.

Figure 2:
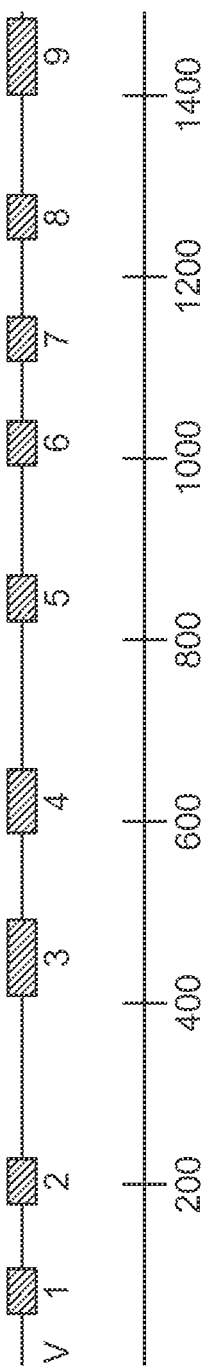
FIG. 2 provides a schematic of 16S rDNA gene and denotes the coordinates of hypervariable regions 1-9 (V1-V9), according to an embodiment of the invention. Coordinates of V1-V9 are 69-99, 137-242, 433-497, 576-682, 822-879, 986-1043, 1117-1173, 1243-1294, and 1435-1465 respectively, based on numbering using *E. coli* system of nomenclature defined by Brosius et al., Complete nucleotide sequence of a 16S ribosomal RNA gene (16S rRNA) from *Escherichia coli*, PNAS 75(10):4801-4805 (1978).

FIG. 2 shows the hypervariable regions mapped onto a 16s sequence and the sequence regions corresponding to these sequences on a sequence map. A schematic is shown of a 16S rDNA gene and the figure denotes the coordinates of hypervariable regions 1-9 (V1-V9), according to an embodiment of the invention. Coordinates of V1-V9 are 69-99, 137-242, 433-497, 576-682, 822-879, 986-1043, 1117-1173, 1243-1294, and 1435-1465 respectively, based on numbering using *E. coli* system of nomenclature defined by Brosius et al. (Complete nucleotide sequence of a 16S ribosomal RNA gene (16S rRNA) from *Escherichia coli*, PNAS USA 75(10):4801-4805. 1978).

Alternatively, other universal bacterial primers or thermostable polymerases known to those skilled in the art are used. For example, primers are available to those skilled in the art for the sequencing of the "V1-V9 regions" of the 16S rDNA (e.g., FIG. 2). These regions refer to the first through ninth hypervariable regions of the 16S rDNA gene that are used for genetic typing of bacterial samples. These regions in bacteria are defined by nucleotides 69-99, 137-242, 433-497, 576-682, 822-879, 986-1043, 1117-1173, 1243-1294 and 1435-1465 respectively using numbering based on the *E. coli* system of nomenclature. See Brosius et al., 1978, supra. In some embodiments, at least one of the V1, V2, V3, V4, V5, V6, V7, V8, and V9 regions are used to characterize an OTU. In one embodiment, the V1, V2, and V3 regions are used to characterize an OTU. In another embodiment, the V3, V4, and V5 regions are used to characterize an OTU. In another embodiment, the V4 region is used to characterize an OTU. A person of ordinary skill in the art can identify the specific hypervariable regions of a candidate 16S rDNA (e.g., FIG. 2) by comparing the candidate sequence in question to the reference sequence (as in FIG. 3) and identifying the hypervariable regions based on similarity to the reference hypervariable regions. FIG. 3 highlights in bold the nucleotide sequences for each hypervariable region in the exemplary reference *E. coli* 16S sequence described by Brosius et al., supra.

The PCR is typically performed on commercially available thermocyclers such as a BioRad MyCycler™ Thermal Cycler (BioRad, Hercules, Calif.). The reactions are run at 94° C. for 2 minutes followed by 30 cycles of 94° C. for 30 seconds, 51° C. for 30 seconds, and 68° C. for 1 minute 30 seconds, followed by a 7 minute extension at 72° C. and an indefinite hold at 4° C. Following PCR, gel electrophoresis of a portion of the reaction products is used to confirm successful amplification of a ~1.5 kb product.

To remove nucleotides and oligonucleotides from the PCR products, 2 µl of HT ExoSap-IT® (Affymetrix, Santa Clara, Calif.) is added to 5 µl of PCR product followed by a 15 minute incubation at 37° C. and then a 15 minute inactivation at 80° C.

Amplification of 16S Sequences for Downstream Characterization by Massively Parallel Sequencing Technologies Amplification performed for downstream sequencing by short read technologies such as Illumina require amplification using primers known to those skilled in the art that additionally include a sequence-based barcoded tag. For example, to amplify the 16s hypervariable region V4 region of bacterial 16S rDNA, 2 µl of extracted gDNA is added to a 20 µl final volume PCR reaction. The PCR reaction also contains 1× HotMasterMix (5PRIME, Gaithersburg, Md.), 200 nM of V4_515f adapt (AATGATACGGCGACCAC-CGAGATCTACACTATGGTAATTGTGTGCCAGCMGC-CGCG GTAA (SEQ ID NO: 2038). IDT, Coralville, Iowa), and 200 nM of barcoded 806rbc (CAAGCAGAAGACG-GCATACGAGAT_
12bpGolayBarcode_AGTCAGTCAGCCGGACTAC HVGGGTWTCTAAT (SEQ ID NO: 2039). IDT, Coralville, Iowa), with PCR Water (Mo Bio Laboratories, Carlsbad, Calif.) for the balance of the volume. In the preceding primer sequences non-ACTG nucleotide designations refer to conventional degenerate codes as are used in the art. These primers incorporate barcoded adapters for Illumina sequencing by synthesis. Optionally, identical replicate, triplicate, or quadruplicate reactions may be performed. Alternatively other universal bacterial primers or thermostable polymerases known to those skilled in the art are used to obtain different amplification and sequencing error rates as well as results on alternative sequencing technologies.

The PCR amplification is performed on commercially available thermocyclers such as a BioRad MyCycler™ Thermal Cycler (BioRad, Hercules, Calif.). The reactions are run at 94° C. for 3 minutes followed by 25 cycles of 94° C. for 45 seconds, 50° C. for 1 minute, and 72° C. for 1 minute 30 seconds, followed by a 10 minute extension at 72° C. and a indefinite hold at 4° C. Following PCR, gel electrophoresis of a portion of the reaction products is used to confirm successful amplification of a ~1.5 kb product. PCR cleanup is performed as described above.

Sanger Sequencing of Target Amplicons from Pure Homogeneous Samples

To detect nucleic acids for each sample, two sequencing reactions are performed to generate a forward and reverse sequencing read. For full-length 16s sequencing primers 27f and 1492r are used. 40 ng of ExoSap-IT-cleaned PCR products are mixed with 25 pmol of sequencing primer and Mo Bio Molecular Biology Grade Water (Mo Bio Laboratories, Carlsbad, Calif.) to 15 µl total volume. This reaction is submitted to a commercial sequencing organization such as Genewiz (South Plainfield, N.J.) for Sanger sequencing.

Amplification of 18S and ITS Regions for Downstream Sequencing

To amplify the 18S or ITS regions, 2 µL fungal DNA were amplified in a final volume of 30 µL with 15 µL AmpliTaq Gold 360 Mastermix, PCR primers, and water. The forward and reverse primers for PCR of the ITS region are 5'-TC-CTCCGCTTATTGATATGC-3' (SEQ ID NO: 2040) and 5'-GGAAGTAAAAGTCGTAACAAGG-3' (SEQ ID NO: 2041) and are added at 0.2 uM concentration each. The forward and reverse primers for the 18s region are 5'-GTAGTCATATGCTTGTCTC-3' (SEQ ID NO: 2042) and 5'-CTTCCGTCAATTCCTTTAAG-3' (SEQ ID NO: 2043) and are added at 0.4 uM concentration each. PCR is performed with the following protocol: 95° C. for 10 minutes, 35 cycles of 95° C. for 15 seconds, 52° C. for 30 seconds, 72° C. for 1.5 seconds; and finally 72° C. for 7 minutes followed by storage at 4° C. All forward primers contained the M13F-20 sequencing primer, and reverse primers included the M13R-27 sequencing primer. PCR products (3 µL) were enzymatically cleaned before cycle sequencing with 1 µL ExoSap-IT and 1 µL Tris EDTA and incubated at 37° C. for 20 minutes followed by 80° C. for 15 minutes. Cycle sequencing reactions contained 5 µL cleaned PCR product, 2 µL BigDye® Terminator v3.1 Ready Reaction Mix, 1 µL 5× Sequencing Buffer, 1.6 pmol of appropriate sequencing primers designed by one skilled in the art, and water in a final volume of 10 pt. The standard cycle sequencing protocol is 27 cycles of 10 seconds at 96° C., 5 seconds at 50° C., 4 minutes at 60° C., and hold at 4° C. Sequencing cleaning is performed with the BigDye XTerminator Purification Kit as recommended by the manufacturer for 10 µL volumes. The genetic sequence of the resulting 18S and ITS sequences is performed using methods familiar to one with ordinary skill in the art using either Sanger sequencing technology or next-generation sequencing technologies such as but not limited to Illumina.

Preparation of Extracted Nucleic Acids for Metagenomic Characterization by Massively Parallel Sequencing Technologies Extracted nucleic acids (DNA or RNA) are purified and prepared by downstream sequencing using standard methods familiar to one with ordinary skill in the art and as described by the sequencing technology's manufactures instructions for library preparation. In short, RNA or DNA are purified using standard purification kits such as but not limited to Qiagen's RNeasy® Kit or Promega's Genomic DNA purification kit. For RNA, the RNA is converted to cDNA prior to sequence library construction. Following purification of nucleic acids, RNA is converted to cDNA using reverse transcription technology such as but not limited to Nugen Ovation® RNA-Seq System or Illumina Truseq as per the manufacturer's instructions. Extracted DNA or transcribed cDNA are sheared using physical (e.g., Hydroshear), acoustic (e.g., Covaris), or molecular (e.g., Nextera) technologies and then size selected as per the sequencing technologies manufacturer's recommendations. Following size selection, nucleic acids are prepared for sequencing as per the manufacturer's instructions for sample indexing and sequencing adapter ligation using methods familiar to one with ordinary skill in the art of genomic sequencing.

Massively Parallel Sequencing of Target Amplicons from Heterogeneous Samples

DNA Quantification & Library Construction

The cleaned PCR amplification products are quantified using the Quant-iT™ PicoGreen® dsDNA Assay Kit (Life Technologies, Grand Island, N.Y.) according to the manufacturer's instructions. Following quantification, the barcoded cleaned PCR products are combined such that each distinct PCR product is at an equimolar ratio to create a prepared Illumina library.

Nucleic Acid Detection

The prepared library is sequenced on Illumina HiSeq or MiSeq sequencers (Illumina, San Diego, Calif.) with cluster generation, template hybridization, isothermal amplification, linearization, blocking and denaturation and hybridization of the sequencing primers performed according to the manufacturer's instructions. 16SV4SeqFw (TATGGTAAT-TGTGTGCCAGCMGCCGCGGTAA (SEQ ID NO: 2044)), 16SV4SeqRev (AGTCAGTCAGCCGGAC-TACHVGGGTWTCTAAT (SEQ ID NO: 2045)), and 16SV4Index (ATTAGAWACCCBDGTAGTCCGGCT-GACTGACT (SEQ ID NO: 2046)) (IDT, Coralville, Iowa) are used for sequencing. Other sequencing technologies can be used such as but not limited to 454, Pacific Biosciences, Helicos, Ion Torrent, and Nanopore using protocols that are standard to someone skilled in the art of genomic sequencing.

Example 13. Sequence Read Annotation

Primary Read Annotation

Nucleic acid sequences are analyzed and annotated to define taxonomic assignments using sequence similarity and phylogenetic placement methods or a combination of the two strategies. A similar approach can be used to annotate protein names, protein function, transcription factor names, and any other classification schema for nucleic acid sequences. Sequence similarity based methods include those familiar to individuals skilled in the art including, but not limited to BLAST. BLASTx, tBLASTn, tBLASTx, RDP-classifier, DNAclust, and various implementations of these algorithms such as Qiime or Mothur. These methods rely on mapping a sequence read to a reference database and selecting the match with the best score and e-value. Common databases include, but are not limited to the Human Microbiome Project, NCBI non-redundant database, Greengenes, RDP, and Silva for taxonomic assignments. For functional assignments reads are mapped to various functional databases such as but not limited to COG, KEGG, BioCyc, and MetaCyc. Further functional annotations can be derived from 16S taxonomic annotations using programs such as PICRUST (M. Langille, et al. 2013. Nature Biotechnology 31, 814-821). Phylogenetic methods can be used in combination with sequence similarity methods to improve the calling accuracy of an annotation or taxonomic assignment. Tree topologies and nodal structure are used to refine the resolution of the analysis. In this approach we analyze nucleic acid sequences using one of numerous sequence similarity approaches and leverage phylogenetic methods that are known to those skilled in the art, including but not limited to maximum likelihood phylogenetic reconstruction (see e.g., Liu et al., 2011. RAxML and FastTree: Comparing Two Methods for Large-Scale Maximum Likelihood Phylogeny Estimation. PLoS ONE 6: e27731; McGuire et al., 2001. Models of sequence evolution for DNA sequences containing gaps. Mol. Biol. Evol 18: 481-490; Wróbel B. 2008. Statistical measures of uncertainty for branches in phylogenetic trees inferred from molecular sequences by using model-based methods. J. Appl. Genet. 49: 49-67). Sequence reads (e.g., 16S, 18S, or ITS) are placed into a reference phylogeny comprised of appropriate reference sequences. Annotations are made based on the placement of the read in the phylogenetic tree. The certainty or significance of the OTU annotation is defined based on the OTU's sequence similarity to a reference nucleic acid sequence and the proximity of the OTU sequence relative to one or more reference sequences in the phylogeny. As an example, the specificity of a taxonomic assignment is defined with confidence at the level of Family, Genus, Species, or Strain with the confidence determined based on the position of bootstrap supported branches in the reference phylogenetic tree relative to the placement of the OTU sequence being interrogated. Nucleic acid sequences can be assigned functional annotations using the methods described above.

Clade Assignments

Clade assignments were generally made using full-length sequences of 16S rDNA and of V4. The ability of 16S-V4 OTU identification to assign an OTU as a specific species depends in part on the resolving power of the 16S-V4 region of the 16S gene for a particular species or group of species. Both the density of available reference 16S sequences for different regions of the tree as well as the inherent variability in the 16S gene between different species will determine the definitiveness of a taxonomic annotation. Given the topological nature of a phylogenetic tree and the fact that tree represents hierarchical relationships of OTUs to one another based on their sequence similarity and an underlying evolutionary model, taxonomic annotations of a read can be rolled up to a higher level using a clade-based assignment procedure. Using this approach, clades are defined based on the topology of a phylogenetic tree that is constructed from full-length 16S sequences using maximum likelihood or other phylogenetic models familiar to individuals with ordinary skill in the art of phylogenetics. Clades are constructed to ensure that all OTUs in a given clade are: (i) within a specified number of bootstrap supported nodes from one another (generally, 1-5 bootstraps), and (ii) share a defined percent similarity (for 16S molecular data typically set to 95%-97% sequence similarity). OTUs that are within the same clade can be distinguished as genetically and phylogenetically distinct from OTUs in a different clade based on 16S-V4 sequence data. OTUs falling within the same clade are evolutionarily closely related and may or may not be distinguishable from one another using 16S-V4 sequence data. The power of clade based analysis is that members of the same clade, due to their evolutionary relatedness, are likely to play similar functional roles in a microbial ecology such as that found in the human gut. Compositions substituting one species with another from the same clade are likely to have conserved ecological function and therefore are useful in the present invention. Notably in addition to 16S-V4 sequences, clade-based analysis can be used to analyze 18S, ITS, and other genetic sequences.

Notably, 16S sequences of isolates of a given OTU are phylogenetically placed within their respective clades, sometimes in conflict with the microbiological-based assignment of species and genus that may have preceded 16S-based assignment. Discrepancies between taxonomic assignments based on microbiological characteristics versus genetic sequencing are known to exist from the literature.

For a given network ecology or functional network ecology one can define a set of OTUs from the network's representative clades. As example, if a network was comprised of clade_100 and clade_102 it can be said to be comprised of at least one OTU from the group consisting of *Corynebacterium coyleae, Corynebacterium mucifaciens,* and *Corynebacterium ureicelerivorans,* and at least one OTU from the group consisting of *Corynebacterium appendicis, Corynebacterium genitalium, Corynebacterium glaucum, Corynebacterium imitans, Corynebacterium riegelii, Corynebacterium* sp. L_2012475, *Corynebacterium* sp. NML 93_0481, *Corynebacterium sundsvallense,* and *Corynebacterium tuscaniae* (see Table 1). Conversely as example, if a network was said to consist of *Corynebacterium coyleae* and/or *Corynebacterium mucifaciens* and/or *Corynebacterium ureicelerivorans,* and also consisted of *Corynebacterium appendicis* and/or *Corynebacterium genitalium* and/or *Corynebacterium glaucum* and/or *Corynebacterium imitans* and/or *Corynebacterium riegelii* and/or *Corynebacterium* sp. L_2012475 and/or *Corynebacterium* sp. NML 93_0481 and/or *Corynebacterium sundsvallense* and/or *Corynebacterium tuscaniae* it can be said to be comprised of clade_100 and clade_102.

The applicants made clade assignments to all OTUs disclosed herein using the above described method and these assignments are reported in Table 1. Results of the network analysis provides, in some embodiments, e.g., of compositions, substitution of clade_172 by clade_172i. In another embodiment, the network analysis provides substitution of clade_198 by clade_198i. In another embodiment, the network analysis permits substitution of clade_260 by clade_260c, clade_260g or clade_260h. In another embodiment, the network analysis permits substitution of clade_262 by clade_262i. In another embodiment, the network analysis permits substitution of clade_309 by clade_309c, clade_309e, clade_309g, clade_309h or clade_309i. In another embodiment, the network analysis permits substitution of clade_313 by clade_313f. In another embodiment, the network analysis permits substitution of clade_325 by clade_325f. In another embodiment, the network analysis permits substitution of clade_335 by clade_335i. In another embodiment, the network analysis permits substitution of clade_351 by clade_351e. In another embodiment, the network analysis permits substitution of clade_354 by clade_354e. In another embodiment, the network analysis permits substitution of clade_360 by clade_360c, clade_360g, clade_360h, or clade_360i. In another embodiment, the network analysis permits substitution of clade_378 by clade_378e. In another embodiment, the network analysis permits substitution of elade_38 by clade_38e or clade_38i. In another embodiment, the network analysis permits substitution of clade 408 by clade_408b, clade_408d, clade_408f, clade_408g or clade_408h. In another embodiment, the network analysis permits substitution of clade_420 by clade_420f. In another embodiment, the network analysis permits substitution of clade_444 by clade_444i. In another embodiment, the network analysis permits substitution of clade_478 by clade_478i. In another embodiment, the network analysis permits substitution of clade_479 by clade_479c, by clade_479g or by clade_479h. In another embodiment, the network analysis permits substitution of clade_481 by clade_481a, clade_481 b, clade_481e, clade_481g, clade_481h or by clade_481i. In another embodiment, the network analysis substitution of clade_497 by clade_497e or by clade_497f. In another embodiment, the network analysis permits substitution of clade_512 by clade_512i. In another embodiment, the network analysis permits the network analysis permits substitutions of clade 0.516 by clade_516c, by clade_516g or by clade_516h. In another embodiment, the network analysis permits the network analysis permits substitutions of clade_522 by clade_522i. In another embodiment, the network analysis permits the network analysis permits substitutions of clade_553 by clade_553i. In another embodiment, the network analysis permits the network analysis permits substitutions of clade_566 by clade_566f. In another embodiment, the network analysis permits the network analysis permits substitutions of clade_572 by clade_572i. In another embodiment, the network analysis permits the network analysis permits substitutions of clade_65 by clade_65e. In another embodiment, the network analysis permits the network analysis permits substitutions of clade_92 by clade_92e or by clade_92i. In another embodiment, the network analysis permits the network analysis permits substitutions of clade_96 by clade_96g or by clade_96h. In another embodiment, the network analysis permits the network analysis permits substitutions of clade_98 by clade_98i. These permitted clade substitutions are described in Table 2.

Metagenomic Read Annotation

Metagenomic or whole genome shotgun sequence data is annotated as described above, with the additional step that sequences are either clustered or assembled prior to annotation. Following sequence characterization as described above, sequence reads are demultiplexed using the indexing (i.e. barcodes). Following demultiplexing sequence reads are either: (i) clustered using a rapid clustering algorithm such as but not limited to UCLUST (http://drive5.com/usearch/manual/uclust_algo.html) or hash methods such VICUNA (Xiao Yang, Patrick Charlebois, Sante Gnerre, Matthew G Coole, Niall J. Lennon, Joshua Z. Levin, James Qu, Elizabeth M. Ryan, Michael C. Zody, and Matthew R. Henn. 2012. De novo assembly of highly diverse viral populations. BMC Genomics 13:475). Following clustering a representative read for each cluster is identified based and analyzed as described above in "Primary Read Annotation". The result of the primary annotation is then applied to all reads in a given cluster. (ii) A second strategy for metagenomic sequence analysis is genome assembly followed by annotation of genomic assemblies using a platform such as but not limited to MetAMOS (Treangen et al. 2013 Genome Biology 14:R2), HUMAaN (Abubucker et al. 2012. Metabolic Reconstruction for Metagenomic Data and Its Application to the Human Microbiome ed. J. A. Eisen. PLoS Computational Biology 8: e1002358) and other methods familiar to one of skill in the art.

Example 14. OTU Identification Using Microbial Culturing Techniques

The identity of the bacterial species that grow up from a complex fraction can be determined in multiple ways. For example, individual colonies can be picked into liquid media in a 96 well format, grown up and saved as 15% glycerol stocks at −80° C. Aliquots of the cultures can be placed into cell lysis buffer and colony PCR methods can be used to amplify and sequence the 16S rDNA gene (Example 1). Alternatively, colonies may be streaked to purity in several passages on solid media. Well-separated colonies are streaked onto the fresh plates of the same kind and incubated for 48-72 hours at 37° C. The process is repeated multiple times to ensure purity. Pure cultures can be analyzed by phenotypic- or sequence-based methods, including 16S rDNA amplification and sequencing as described in Example 1. Sequence characterization of pure isolates or mixed communities e.g., plate scrapes and spore fractions can also include whole genome shotgun sequencing. The latter is valuable to determine the presence of genes associated with sporulation, antibiotic resistance, pathogenicity, and virulence. Colonies can also be scraped from plates en masse and sequenced using a massively parallel sequencing method as described in Example 1 such that individual 16S signatures can be identified in a complex mixture. Optionally, the sample can be sequenced prior to germination (if appropriate DNA isolation procedures are used to lyse and release the DNA from spores) in order to compare the diversity of germinable species with the total number of species in a spore sample. As an alternative or complementary approach to 16S analysis, MALDI-TOF-mass spec can also be used for species identification (Barreau et al., 2013. Improving the identification of anaerobes in the clinical microbiology laboratory through MALDI-TOF mass spectrometry. Anaerobe 22: 123-125).

Example 15. Microbiological Strain Identification Approaches

Pure bacterial isolates can be identified using microbiological methods as described in Wadsworth-KTL Anaerobic Microbiology Manual (Jouseimies-Somer et al., 2002. Wadsworth-KTL Anaerobic Bacteriology Manual), and The Manual of Clinical Microbiology (ASM Press, 10th Edition). These methods rely on phenotypes of strains and include Gram-staining to confirm Gram positive or negative staining behavior of the cell envelope, observance of colony morphologies on solid media, motility, cell morphology observed microscopically at 60× or 100× magnification including the presence of bacterial endospores and flagella. Biochemical tests that discriminate between genera and species are performed using appropriate selective and differential agars and/or commercially available kits for identification of Gram-negative and Gram-positive bacteria and yeast, for example, RapID tests (Remel) or API tests (bioMerieux). Similar identification tests can also be performed using instrumentation such as the Vitek 2 system (bioMerieux). Phenotypic tests that discriminate between genera and species and strains (for example the ability to use various carbon and nitrogen sources) can also be performed using growth and metabolic activity detection methods, for example the Biolog Microbial identification microplates. The profile of short chain fatty acid production during fermentation of particular carbon sources can also be used as a way to discriminate between species (Wadsworth-KTL Anaerobic Microbiology Manual, Jousimies-Somer, et al 2002). MALDI-TOF-mass spectrometry can also be used for species identification (as reviewed in Anaerobe 22:123).

Example 16. Construction of an In Vitro Assay to Screen for Combinations of Microbes Inhibitory to the Growth of Pathogenic *E. coli*

A modification of the in vitro assay described herein is used to screen for combinations of bacteria inhibitory to the growth of *E. coli*. In general, the assay is modified by using a medium suitable for growth of the pathogen inoculum. For example, suitable media include Reinforced Clostridial Media (RCM), Brain Heart Infusion Broth (BHI) or Luria Bertani Broth (LB) (also known as Lysogeny Broth). *E. coli* is quantified by using alternative selective media specific for *E. coli* or using qPCR probes specific for the pathogen. For example, aerobic growth on MacConkey lactose medium selects for enteric Gram-negative bacteria, including *E. coli*. qPCR is conducted using probes specific for the shiga toxin of pathogenic *E. coli*.

In general, the method can be used to test compositions in vitro for their ability to inhibit growth of any pathogen that can be cultured.

Example 17. Construction of an In Vitro Assay to Screen for Combinations of Microbes Inhibitory to the Growth of Vancomycin-Resistant *Enterococcus* (VRE)

The in vitro assay can be used to screen for combinations of bacteria inhibitory to the growth of vancomycin-resistant *Enterococcus* spp. (VRE) by modifying the media used for growth of the pathogen inoculum. Several choices of media can be used for growth of the pathogen such as Reinforced Clostridial Media (RCM), Brain Heart Infusion Broth (BHI) or Luria Bertani Broth (LB). VRE is quantified by using alternative selective media specific for VRE or using qPCR probes specific for the pathogen. For example, m-*Enterococcus* agar containing sodium azide is selective for *Enterococcus* spp. and a small number of other species. Probes known in the art that are specific to the van genes conferring vancomycin resistance are used in the qPCR or such probes can be designed using methods known in the art.

Example 18. In Vitro Assay Screening Bacterial Compositions for Inhibition of *Salmonella*

The in vitro assay described herein is used to screen for combinations of bacteria inhibitory to the growth of *Salmonella* spp. by modifying the media used for growth of the pathogen inoculum. Several choices of media are used for growth of the pathogen such as Reinforced Clostridial Media (RCM), Brain Heart Infusion Broth (BHI) or Luria Bertani Broth (LB). *Salmonella* spp. are quantified by using alternative selective media specific for *Salmonella* spp. or using qPCR probes specific for the pathogen. For example, MacConkey agar is used to select for *Salmonella* spp. and the invA gene is targeted with qPCR probes; this gene encodes an invasion protein carried by many pathogenic *Salmonella* spp. and is used in invading eukaryotic cells.

Example 19. In Vivo Validation of the Efficacy of Network Ecology Bacterial Compositions for Prevention of *Clostridium difficile* Infection in a Murine Model To test the therapeutic potential of the bacterial composition, a prophylactic mouse model of *C. difficile* infection was used (model based on Chen et al., 2008. A mouse model of *Clostridium difficile*-associated disease. Gastroenterology 135: 1984-1992). Two cages of five mice each were tested for each arm of the experiment. All mice received an antibiotic cocktail consisting of 10% glucose, kanamycin (0.5 mg/ml), gentamicin (0.044 mg/ml), colistin (1062.5 U/ml), metronidazole (0.269 mg/ml), ciprofloxacin (0.156 mg/ml), ampicillin (0.1 mg/ml) and vancomycin (0.056 mg/ml) in their drinking water on days −14 through −5 and a dose of 10 mg/kg clindamycin by oral gavage on day −3. On day −1, test articles were spun for 5 minutes at 12,100 rcf, their supernatants' removed, and the remaining pellets were resuspended in sterile PBS, prereduced if bacterial composition was not in spore form, and delivered via oral gavage. On day 0 they were challenged by administration of approximately 4.5 log 10 cfu of *C. difficile* (ATCC 43255) or sterile PBS (for the naive arm) via oral gavage. Optionally a positive control group received vancomycin from day −1 through day 3 in addition to the antibiotic protocol and *C. difficile* challenge specified above. Stool were collected from the cages for analysis of bacterial carriage. Mortality, weight and clinical scoring of *C. difficile* symptoms based upon a 0-4 scale by combining scores for appearance (0-2 points based on normal, hunched, piloerection, or lethargic), and clinical signs (0-2 points based on normal, wet tail, cold-to-the-touch, or isolation from other animals) are assessed every day from day −2 through day 6. Mean minimum weight relative to day −1 and mean maximum clinical score where a death was assigned a clinical score of 4 as well as average cumulative mortality are calculated. Reduced mortality, increased mean minimum weight relative to day −1, and reduced mean maximum clinical score with death assigned to a score of 4 relative to the vehicle control are used to assess the success of the test article.

Table 9 and Table 10 report results for 14 experiments in the prophylactic mouse model of *C. difficile* infection where treatment was with a bacterial composition. In the 14 experiments, 157 of the arms tested network ecologies, with 86 distinct networks ecologies tested (Table 10). Indicia of efficacy of a composition (test article) in these experiments is a low cumulative mortality for the test composition relative to the vehicle control, a mean minimum relative weight of at least 0.85 (e.g., at least 0.90, at least 0.95, or at least 0.97), and a mean maximum clinical score less than 1, e.g., 0.9, 0.8, 0.7, 0.5, 0.2, or 0. Of the 157 arms of the experiment, 136 of the arms and 73 of the networks performed better than the respective experiment's vehicle control arm by at least one of the following metrics: cumulative mortality, mean minimum relative weight, and mean maximum clinical score. Examples of efficacious networks include but are not limited to networks N1979 as tested in SP-361 which had 0% cumulative mortality, 0.97 mean minimum relative weight, and 0 mean maximum clinical score or N2007 which had 10% cumulative mortality, 0.91 mean minimum relative weight, and 0.9 mean maximum clinical score with both networks compared to the vehicle control in SP-361 which had 30% cumulative mortality, 0.88 mean minimum relative weight, and 2.4 mean maximum clinical score. In SP-376, N1962 had no cumulative mortality, mean maximum clinical scores of 0 at both target doses tested with mean minimum relative weights of 0.98 and 0.95 for target doses of 1e8 and 1e7 CFU/OTU/mouse respectively. These results confirm that bacterial compositions comprised of binary and ternary and combinations thereof are efficacious as demonstrated using the mouse model.

Figure 5:
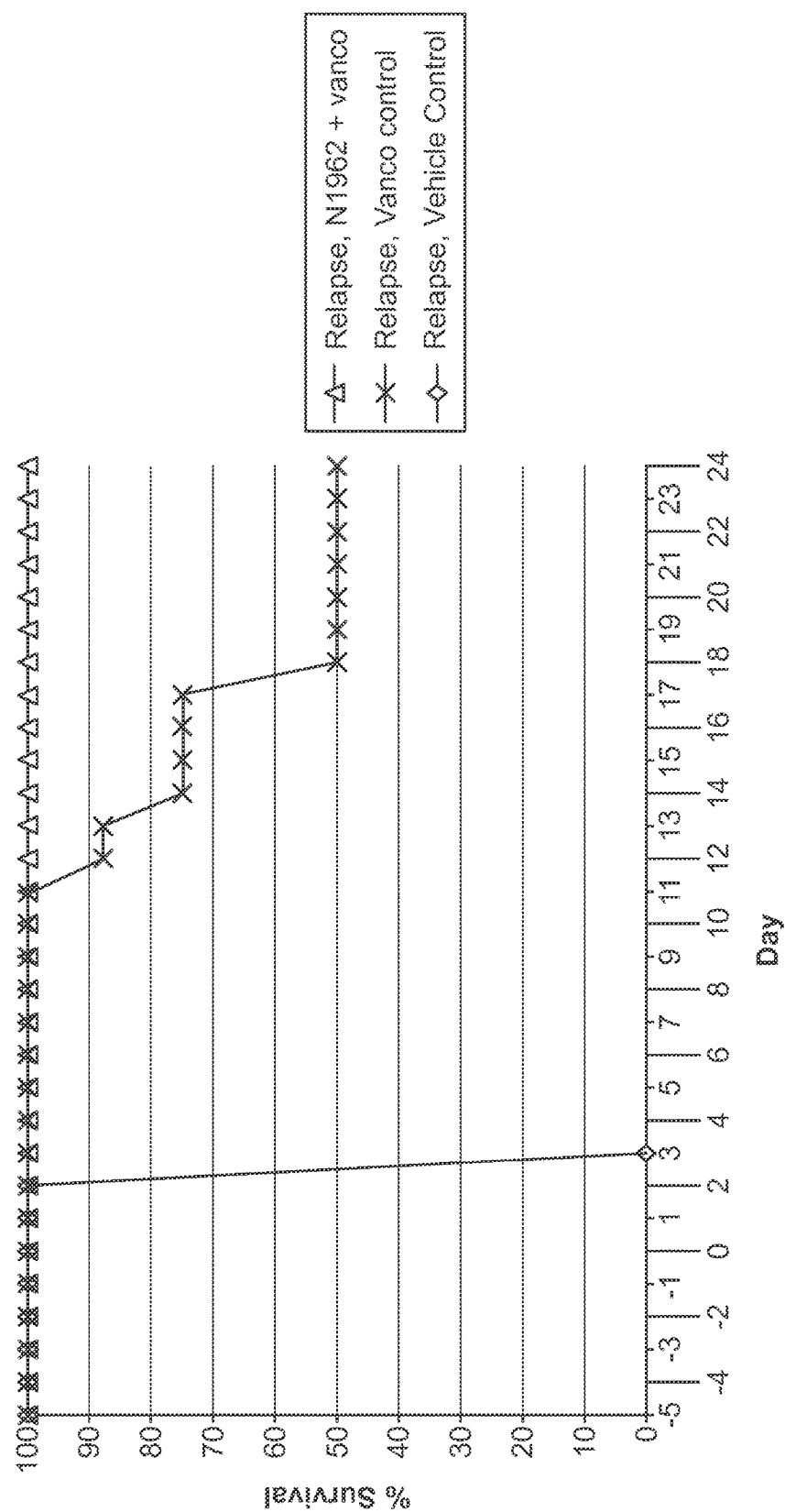
FIG. 5 shows an in vivo hamster *Clostridium difficile* relapse prevention model to validate efficacy of network ecology bacterial composition, according to an embodiment of the invention.

Example 20. In Vivo Validation of Network Ecology Bacterial Composition Efficacy in Prophylactic and Relapse Prevention Hamster Model Previous studies with hamsters using toxigenic and non-toxigenic strains of *C. difficile* demonstrated the utility of the hamster model in examining relapse post antibiotic treatment and the effects of prophylaxis treatments with cecal flora in *C. difficile* infection (Wilson et al., 1981. Infect Immun 34:626-628), Wilson et al., 1983. J Infect Dis 147:733, Borriello et al., 1985. J Med Microbiol 19:339-350) and more broadly in gastrointestinal infectious disease. Accordingly, to demonstrate prophylactic use of bacterial compositions comprising specific operational taxonomic units to ameliorate *C. difficile* infection, the following hamster model was used. Clindamycin (10 mg/kg s.c.) was administered to animals on day −5, the test composition or control was administered on day −3, and *C. difficile* challenge occurred on day 0. In the positive control arm, vancomycin was then administered on days 1-5 (and vehicle control was delivered on day −3). Stool were collected on days −5, −4, −1, 1, 3, 5, 7, 9 and fecal samples were assessed for pathogen carriage and reduction by microbiological methods. 16S sequencing approaches or other methods could also be utilized by one skilled in the art. Mortality was assessed multiple times per day through 21 days post *C. difficile* challenge. The percentage survival curves showed that a bacterial composition (N1962) comprised of OTUs that were shown to be inhibitory against *C. difficile* in an in vitro inhibition assay (see above examples) better protected the hamsters compared to the vancomycin control, and vehicle control (FIG. 5).

These data demonstrate the efficacy of a composition in vivo, as well as the utility of using an in vitro inhibition method as described herein to predict compositions that have activity in vivo.

Example 21. Method of Preparing a Bacterial Composition for Administration to a Subject Two or more strains that comprise the bacterial composition are independently cultured and mixed together before administration. Both strains are independently be grown at 37° C., pH 7, in a GMM or other animal-products-free medium, pre-reduced with 1 g/L cysteine HCl. After each strain reaches a sufficient biomass, it is preserved for banking by adding 15% glycerol and then frozen at −80° C. in 1 ml cryotubes.

Each strain is then be cultivated to a concentration of $10^{10}$ CFU/mL, then concentrated 20-fold by tangential flow microfiltration; the spent medium is exchanged by diafiltering with a preservative medium consisting of 2% gelatin, 100 mM trehalose, and 10 mM sodium phosphate buffer, or other suitable preservative medium. The suspension is freeze-dried to a powder and titrated.

After drying, the powder is blended with microcrystalline cellulose and magnesium stearate and formulated into a 250 mg gelatin capsule containing 10 mg of lyophilized powder ($10^8$ to $10^{11}$ bacteria), 160 mg microcrystalline cellulose, 77.5 mg gelatin, and 2.5 mg magnesium stearate.

A bacterial composition can be derived by selectively fractionating the desired bacterial OTUs from a raw material such as but not limited to stool. As an example, a 10% w/v suspension of human stool material in PBS was prepared that was filtered, centrifuged at low speed, and then the supernatant containing spores was mixed with absolute ethanol in a 1:1 ratio and vortexed to mix. The suspension was incubated at room temperature for 1 hour. After incubation the suspension was centrifuged at high speed to concentrate spores into a pellet containing a purified spore-containing preparation. The supernatant was discarded and the pellet resuspended in an equal mass of glycerol, and the purified spore preparation was placed into capsules and stored at −80° C.; this preparation is referred to as an ethanol-treated spore population.

Example 22. Method of Treating a Subject with Recurrent *C. difficile* Infection with a Bacterial Composition In one example, a subject has suffered from recurrent bouts of *C. difficile*. In the most recent acute phase of the illness, the subject is treated with an antibiotic sufficient to ameliorate the symptoms of the illness. To prevent another relapse of *C. difficile* infection, a bacterial composition described herein is administered to the subject. For example, the subject is administered one of the present bacterial compositions at a dose in the range of $1e10^7$ to $1e10^{12}$ in, e.g., a lyophilized form, in one or more gelatin capsules (e.g., 2, 3, 4, 5, 10, 15 or more capsules) containing 10 mg of lyophilized bacteria and stabilizing components. The capsule is administered by mouth and the subject resumes a normal diet after 4, 8, 12, or 24 hours. In another embodiment, the subject may take the capsule by mouth before, during, or immediately after a meal. In a further embodiment, the subject takes the dose daily for a specified period of time.

Stool is collected from the subject before and after treatment. In one embodiment stool is collected at 1 day, 3 days, 1 week, and 1 month after administration. The presence of *C. difficile* is found in the stool before administration of the bacterial composition, but stool collections after administration show a reduction in the level of *C. difficile* in the stool (for example, at least 50% less, 60%, 70%, 80%, 90%, or 95%) to no detectable levels of *C. difficile*, as measured by qPCR and if appropriate, compared to a healthy reference subject microbiome, as described above. Typically, the quantitation is performed using material extracted from the same amounts of starting material, e.g., stool. ELISA for toxin protein or traditional microbiological identification techniques may also be used. Effective treatment is defined as a reduction in the amount of *C. difficile* present after treatment.

In some cases, effective treatment, i.e., a positive response to treatment with a composition disclosed herein is defined as absence of diarrhea, which itself is defined as 3 or more loose or watery stools per day for at least 2 consecutive days or 8 or more loose or watery stools in 48 hours, or persisting diarrhea (due to other causes) with repeating (three times) negative stool tests for toxins of *C. difficile*.

Treatment failure is defined as persisting diarrhea with a positive *C. difficile* toxin stool test or no reduction in levels of *C. difficile*, as measured by qPCR sequencing. ELISA or traditional microbiological identification techniques may also be used.

In some cases, effective treatment is determined by the lack of recurrence of signs or symptoms of *C. difficile* infection within, e.g., 2 weeks, 3 weeks, 4 weeks, 5 weeks, 10 weeks, 12 weeks, 16 weeks, 20 weeks, or 24 weeks after the treatment.

Example 23. Treatment of Subjects with *Clostridium difficile* Associated Diarrheal Disease with a Bacterial Composition Microbial Population Engraftment, Augmentation, and Reduction of Pathogen Carriage in Patients Treated with Spore Compositions Complementary genomic and microbiological methods were used to characterize the composition of the microbiota of 15 subjects with recurrent *C. difficile* associated disease (CDAD) that were treated with a bacterial composition. The microbiome of these subjects was characterized pretreatment and initially up to 4 weeks post-treatment and further to 24 weeks. An additional 15 subjects were treated and data for those subjects was collected to at least 8 weeks post-treatment and up to 24 weeks post-treatment. The bacterial compositions used for treatment were comprised of spore forming bacteria and constitute a microbial spore ecology derived from healthy human stool. Methods for preparing such compositions can be found in PCT/US2014/014715.

Figure 6:
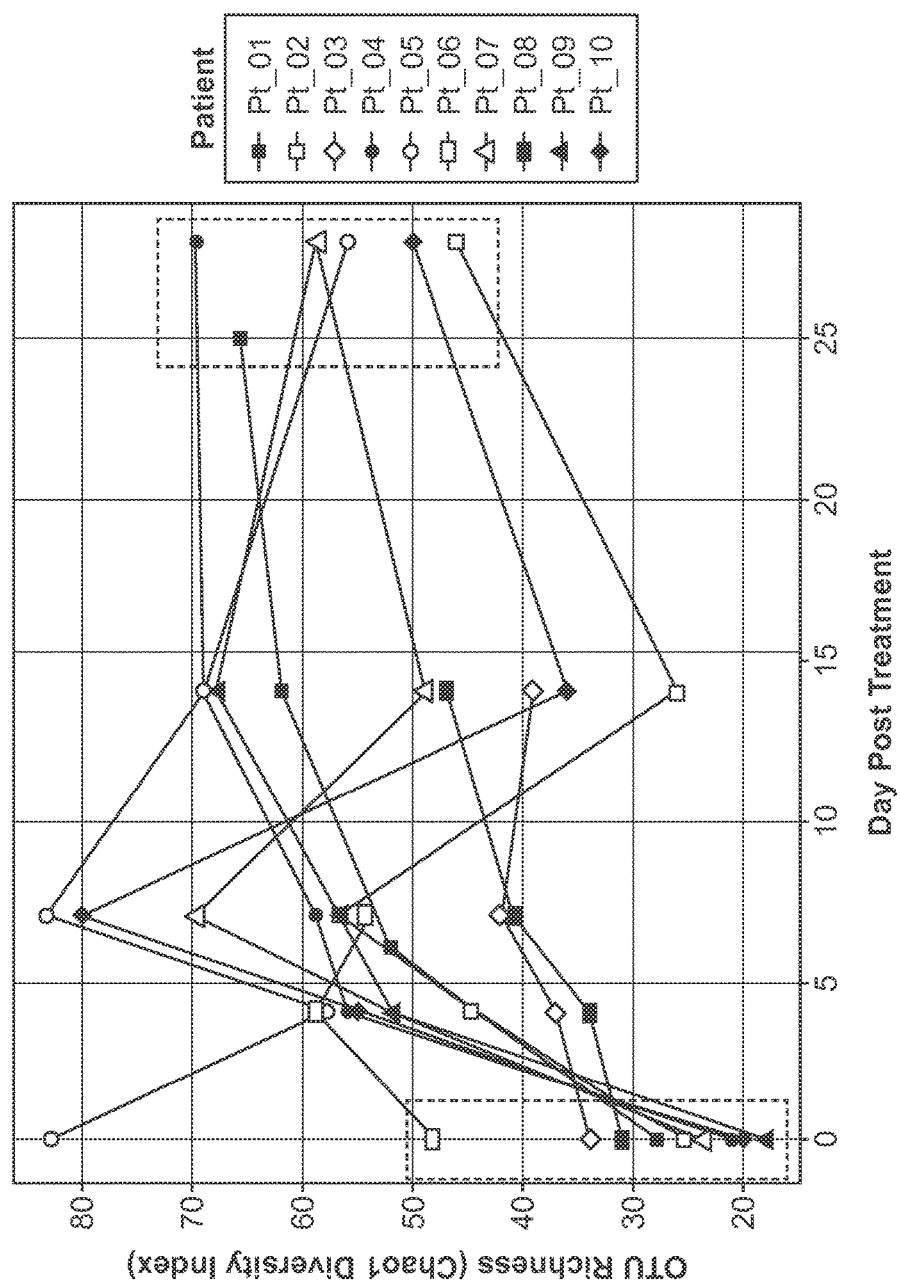
FIG. 6 shows the increase in the total microbial diversity (measured using the Chao-1 diversity index) in the gut of human subjects with recurrent *Clostridium difficile* associated disease pretreatment and post-treatment with a microbial spore ecology.
Figure 7:
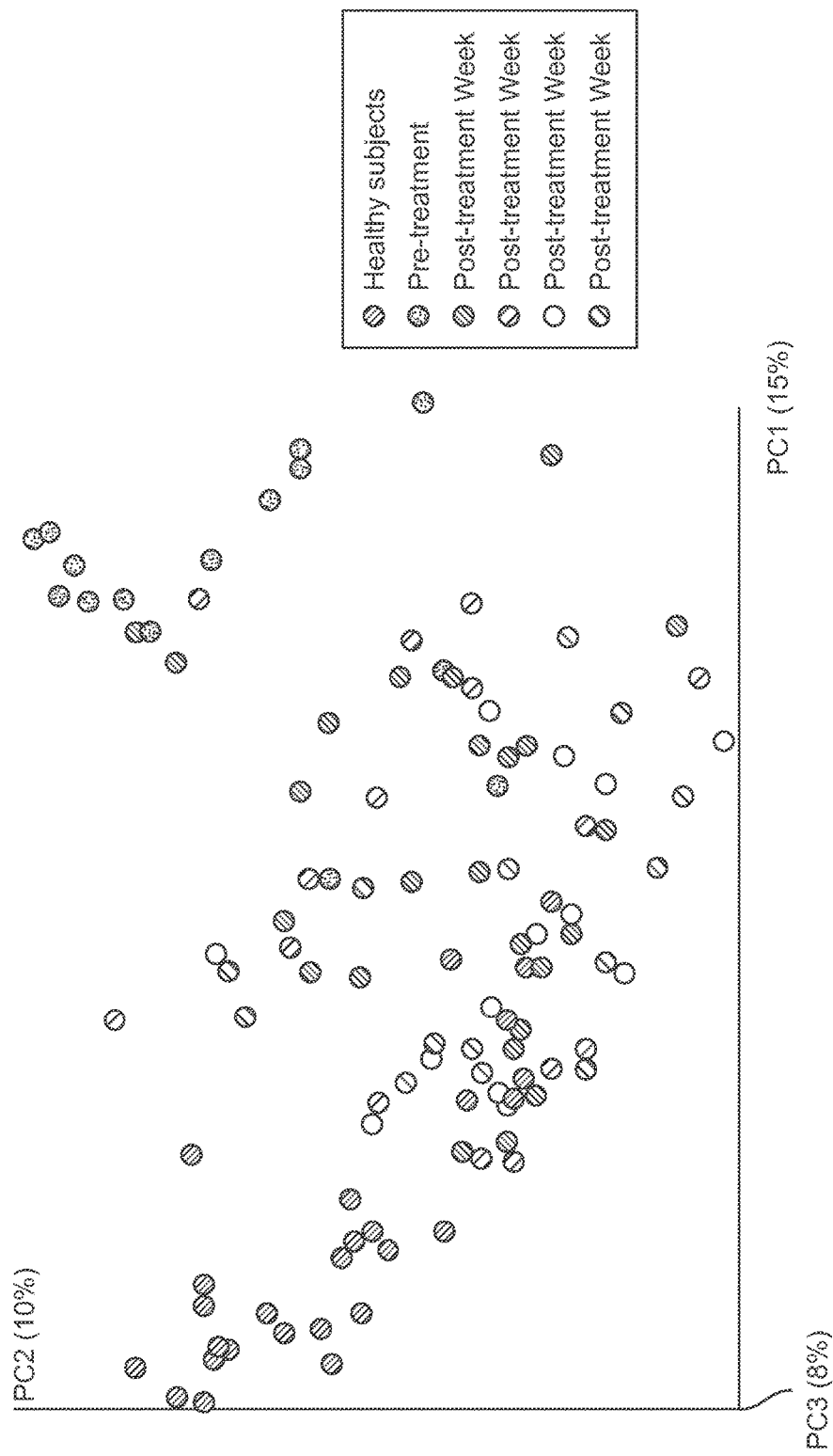
FIG. 7 shows the compositional change in the microbiome (measured using the Bray-Curtis PCoA metric) in the gut of human subjects with recurrent *Clostridium difficile* associated disease pretreatment and post-treatment with a microbial spore ecology.

Non-limiting exemplary OTUs and clades of the spore forming microbes identified in the initial compositions are provided in Table 11. OTUs and clades in the spore ecology treatment were observed in 1 to 15 of the initial 15 subjects treated (Table 11) and in subsequently treated subjects. Treatment of the subjects with the microbial spore ecology resolved *C. difficile* associated disease (CDAD) in all subjects treated. In addition, treatment with the microbial spore composition led to the reduction or removal of Gram(−) and Gram(+) pathobionts including but not limited to pathobionts with multi-drug resistance such as but not limited to vancomycin-resistant Enterococci (VRE) and carbapenem- or imipenem resistant bacteria. Additionally, treatment led to an increase in the total microbial diversity of the subjects gut microbiome (FIG. 6) and the resulting microbial community that established as the result of treatment with the microbial spore ecology was different from the microbiome pretreatment and more closely represented that of a healthy individual than that of an individual with CDAD (FIG. 7).

Using novel computational approaches, applicants delineated bacterial OTUs associated with engraftment and ecological augmentation and establishment of a more diverse microbial ecology in patients treated with an ethanol-treated spore preparation (Table 11). OTUs that comprise an augmented ecology are those below the limit of detection in the patient prior to treatment and/or exist at extremely low frequencies such that they do not comprise a significant fraction of the total microbial carriage and are not detectable by genomic and/or microbiological assay methods in the bacterial composition. OTUs that are members of the engrafting and augmented ecologies were identified by characterizing the OTUs that increase in their relative abundance post treatment and that respectively are: (i) present in the ethanol-treated spore preparation and not detectable in the patient pretreatment (engrafting OTUs), or (ii) absent in the ethanol-treated spore preparation, but increase in their relative abundance in the patient through time post treatment with the preparation due to the formation of favorable growth conditions by the treatment (augmenting OTUs). Augmenting OTUs can grow from low frequency reservoirs in the patient, or can be introduced from exogenous sources such as diet.

Notably, 16S sequences of isolates of a given OTU are phylogenetically placed within their respective clades despite that the actual taxonomic assignment of species and genus may suggest they are taxonomically distinct from other members of the clades in which they fall. Discrepancies between taxonomic names given to an OTU is based on microbiological characteristics versus genetic sequencing are known to exist from the literature. The OTUs footnoted in this table are known to be discrepant between the different methods for assigning a taxonomic name.

Rational Design of Therapeutic Compositions from Core Ecologies

To define the Core Ecology underlying the remarkable clinical efficacy of the microbial spore bacterial the following analysis was carried out. The OTU composition of the microbial spore ecology was determined by 16S-V4 rDNA sequencing and computational assignment of OTUs per Example 13. A requirement to detect at least ten sequence reads in the microbial spore ecology was set as a conservative threshold to define only OTUs that were highly unlikely to arise from errors during amplification or sequencing. Methods routinely employed by those familiar to the art of genomic-based microbiome characterization use a read relative abundance threshold of 0.005% (see e.g., Bokulich et al. 2013. Quality-filtering vastly improves diversity estimates from Illumina amplicon sequencing. Nature Methods 10: 57-59), which would equate to ≥2 reads given the sequencing depth obtained for the samples analyzed in this example, as cut-off which is substantially lower than the ≥10 reads used in this analysis. All taxonomic and clade assignments were made for each OTU as described in Example 13. The resulting list of OTUs, clade assignments, and frequency of detection in the spore preparations are shown in Table 11.

In one embodiment, OTUs that comprise a "core" bacterial composition of a microbial spore ecology, augmented ecology or engrafted ecology can be defined by the percentage of total subjects in which they are observed; the greater this percentage the more likely they are to be part of a core ecology responsible for catalyzing a shift away from a dysbiotic ecology. In one embodiment, therapeutic bacterial compositions are rationally designed by identifying the OTUs that occur in the greatest number of subjects evaluated. In one embodiment OTUs that occur in 100% of subjects define a therapeutic bacterial composition. In other embodiments, OTUs that are defined to occur in ≥90%, ≥80%, ≥70%, ≥60%, or ≥50% of the subjects evaluated comprise the therapeutic bacterial composition. In a further embodiment, OTUs that are in either 100%, ≥90%, ≥80%, ≥70%, ≥60%, or ≥50% are further refined to rationally design a therapeutic bacterial composition using phylogenetic parameters or other features such as but not limited to their capacity to metabolize secondary bile acids, illicit TH17 immune signaling, or produce short-chain fatty acids.

In an additional embodiment, the dominant OTUs in an ecology can be identified using several methods including but not limited to defining the OTUs that have the greatest relative abundance in either the augmented or engrafted ecologies and defining a total relative abundance threshold. As example, the dominant OTUs in the augmented ecology of Patient-1 were identified by defining the OTUs with the greatest relative abundance, which together comprise 60% of the microbial carriage in this patient's augmented ecology by day 25 post-treatment.

In a further embodiment, an OTU is assigned to be a member of the Core Ecology of the bacterial composition, that OTU must be shown to engraft in a patient. Engraftment is important for at least two reasons. First, engraftment is believed to be a sine qua non of the mechanism to reshape the microbiome and eliminate *C. difficile* colonization. OTUs that engraft with higher frequency are highly likely to be a component of the Core Ecology of the spore preparation or broadly speaking a set bacterial composition. Second, OTUs detected by sequencing a bacterial composition may include non-viable cells or other contaminant DNA molecules not associated with the composition. The requirement that an OTU must be shown to engraft in the patient eliminates OTUs that represent non-viable cells or contaminating sequences. OTUs that are present in a large percentage of the bacterial composition, e.g., ethanol spore preparations analyzed and that engraft in a large number of patients represent a subset of the Core Ecology that are highly likely to catalyze the shift from a dysbiotic disease ecology to a healthy microbiome. OTUs from which to define such therapeutic bacterial compositions derived of OTUs that engraft are denoted in Table 11.

A third lens was applied to further refine discoveries into the Core Ecology of the bacterial composition (e.g., microbial spore ecology). Computational-based, network analysis has enabled the description of microbial ecologies that are present in the microbiota of a broad population of healthy individuals. These network ecologies are comprised of multiple OTUs, some of which are defined as Keystone OTUs. Keystone OTUs are computationally defined OTUs that occur in a large percentage of computed networks and meet the networks in which they occur are highly prevalent in the population of subjects evaluated. Keystone OTUs form a foundation to the microbially ecologies in that they are found and as such are central to the function of network ecologies in healthy subjects. Keystone OTUs associated with microbial ecologies associated with healthy subjects are often are missing or exist at reduced levels in subjects with disease. Keystone OTUs may exist in low, moderate, or high abundance in subjects.

There are several important findings from these data. A relatively small number of species, 11 in total, are detected in all of the spore preparations from 6 donors and 10 donations. This is surprising because the HMP database (www.hmpdacc.org) describes the enormous variability of commensal species across healthy individuals. The presence of a small number of consistent OTUs lends support to the concept of a Core Ecology and Backbone Networks. The engraftment data further supports this conclusion.

In another embodiment, three factors—prevalence in the bacterial composition such as but not limited to a spore preparation, frequency of engraftment, and designation as a Keystone OTUs—enabled the creation of a "Core Ecology Score" (CES) to rank individual OTUs. CES was defined as follows:

40% Weighting for Presence of OTU in Spore Preparation
multiplier of 1 for presence in 1-3 spore preparations
multiplier of 2.5 for presence in 4-8 spore preparations
multiplier of 5 for presences in ≥9 spore preparations
40% Weighting for Engraftment in a Patient
multiplier of 1 for engraftment in 1-4 patients
multiplier of 2.5 for engraftment in 5-6 patients
multiplier of 5 for engraftment in ≥7 patients
20% Weighting to Keystone OTUs
multiplier of 1 for a Keystone OTU
multiplier of 0 for a non-Keystone OTU Using this guide, the CES has a maximum possible score of 5 and a minimum possible score of 0.8. As an example, an OTU found in 8 of the 10 bacterial composition such as but not limited to a spore preparations that engrafted in 3 patients and was a Keystone OTU would be assigned the follow CES:

$$CES=(0.4\times 2.5)+(0.4\times 1)+(0.2\times 1)=1.6$$

Table 11 provides a rank of OTUs by CES. Bacterial compositions rationally designed using a CES score are highly likely to catalyze the shift from a dysbiotic disease ecology to a healthy microbiome. In additional embodiments, the CES score can be combined with other factors to refine the rational design of a therapeutic bacterial composition. Such factors include but are not limited to: using phylogenetic parameters or other features such as but not limited to their capacity to metabolize secondary bile acids, illicit TH17 immune signaling, or produce short-chain fatty acids. In an additional embodiment, refinement can be done by identifying the OTUs that have the greatest relative abundance in either the augmented or engrafted ecologies and defining a total relative abundance threshold.

The number of organisms in the human gastrointestinal tract, as well as the diversity between healthy individuals, is indicative of the functional redundancy of a healthy gut microbiome ecology (see The Human Microbiome Consortia. 2012. Structure, function and diversity of the healthy human microbiome. Nature 486: 207-214). This redundancy makes it highly likely that subsets of the Core Ecology describe therapeutically beneficial components of the bacterial composition such as but not limited to an ethanol-treated spore preparation and that such subsets may themselves be useful compositions for populating the GI tract and for the treatment of *C. difficile* infection given the ecologies functional characteristics. Using the CES, as well as other key metrics as defined above, individual OTUs can be prioritized for evaluation as an efficacious subset of the Core Ecology.

Another aspect of functional redundancy is that evolutionarily related organisms (i.e., those close to one another on the phylogenetic tree, e.g., those grouped into a single clade) will also be effective substitutes in the Core Ecology or a subset thereof for treating *C. difficile*.

To one skilled in the art, the selection of appropriate OTU subsets for testing in vitro or in vivo is straightforward. Subsets may be selected by picking any 2, 3, 4, 5, 6, 7, 8, 9, 10, or more than 10 OTUs from Table 11, typically selecting those with higher CES. In addition, using the clade relationships defined in Example 13 above and Table 11, related OTUs can be selected as substitutes for OTUs with acceptable CES values. These organisms can be cultured anaerobically in vitro using the appropriate media, and then combined in a desired ratio. A typical experiment in the mouse *C. difficile* model utilizes at least 104 and preferably at least $10^5$, $10^6$, $10^7$, $10^8$, $10^9$ or more than $10^9$ colony forming units of a each microbe in the composition. In some compositions, organisms are combined in unequal ratios, for example, due to variations in culture yields, e.g., 1:10, 1:100, 1:1,000, 1:10,000, 1:100,000, or greater than 1:100,000. What is important in these compositions is that each strain be provided in a minimum amount so that the strain's contribution to the efficacy of the Core Ecology subset can be therapeutically effective, and in some cases, measured. Using the principles and instructions described here, one of skill in the art can make clade-based substitutions to test the efficacy of subsets of the Core Ecology. Table 11 and Table 2 describe the clades for each OTU from which such substitutions can be derived.

Rational Design of Therapeutic Compositions by Integration of In Vitro and Clinical Microbiome Data In one embodiment, efficacious subsets of the treatment microbial spore ecology as well as subsets of the microbial ecology of the subject post-treatment are defined by rationally interrogating and the composition of these ecologies with respect to compositions comprising 2, 3, 4, 5, 6, 7, 8, 9, 10, or some larger number of OTUs. In one embodiment, the bacterial compositions that have demonstrated efficacy in an in vitro pathogen inhibition assay and that are additionally identified as constituents of the ecology of the treatment itself and/or the microbial ecology of 100%, ≥90%, ≥80%, ≥70%, ≥60%, or ≥50% of the subject's can by an individual with ordinary skill in the art be prioritize for functional screening. Functional screens can include but are not limited to in vivo screens using various pathogen or non-pathogen models (as example, murine models, hamster models, primate models, or human). Table 12 provides bacterial compositions that exhibited inhibition against *C. difficile* as measured by a mean log inhibition greater than the 99% confidence interval (C.I) of the null hypothesis (see Example 6, ++++) and that are identified in at least one spore ecology treatment or subject post-treatment. In another embodiment compositions found in the 95%, 90%, or 80% confidence intervals (C.I.) and occurring in the treatment and post-treatment ecologies are selected. In other embodiments, bacterial compositions are selected for screening for therapeutic potential by selecting OTUs that occur in the treatment or post-treatment ecologies and the measured growth inhibition of the composition is ranked ≥the 75th percentile of all growth inhibition scores. In other embodiments, compositions ranked ≥the 50th, 60th, 70th, 80th, 90th, 95th, or 99th percentiles are selected. In another embodiment, compositions demonstrated to have synergistic inhibition are selected (see Example 7). In yet a further embodiment, compositions selected to screen for efficacy in in vivo models are selected using a combination of growth inhibition metrics. As non-limiting example: (i) compositions are first selected based on their log inhibition being greater than the 99% confidence interval (C.I.) of the null hypothesis. (ii) then this subset of compositions further selected to represent those that are ranked ≥the 75th percentile in the distribution of all inhibition scores, (iii) this subset is then further selected based on compositions that demonstrate synergistic inhibition. In some embodiments, different confidence intervals (C.I.) and percentiles are used to subset and rationally select the compositions. In yet another embodiment, bacterial compositions are further rationally defined for their therapeutic potential using phylogenetic criteria, such as but not limited to, the presence of particular phylogenetic clade, or other features such as but not limited to their capacity to metabolize secondary bile acids, illicit TH17 immune signaling, or produce short-chain fatty acids.

In a related embodiment, all unique bacterial compositions that can be delineated in silico using the OTUs that occur in 100% of the dose spore ecologies are defined; exemplary bacterial compositions are denoted in Table 13. In other embodiments, compositions are derived form OTUs that occur in ≥90%, ≥80%, ≥70%, ≥60%, or ≥50% of the dose spore ecology or the subject's post-treatment ecologies. One with ordinary skill in the art can interrogate the resulting bacterial compositions and using various metrics including, but not limited to the percentage of spore formers, the presence of keystone OTUs, phylogenetic composition, or the OTUs' ability to metabolize secondary bile acids or the ability to produce short-chain fatty acids to rationally define bacterial compositions with suspected efficacy and suitability for further screening.

Example 24. Computational Analysis of Administered Spore Ecology Dose Compositions, and Augmentation and Engraftment Following Administration of Spore Ecology Doses The clinical trial described in Example 23 enrolled 15 additional subjects. Further analyses were carried out on information combining data from all subjects responding to treatment in the trial (29 of 30 subjects). The treatment was with a complex formulation of microbes derived from human stool. Analyses of these results are provided in Tables 14-21. Table 22 is provided for convenience, and lists alternative names for certain organisms. Typically, the presence of an OTU is made using a method known in the art, for example, using qPCR under conditions known in the art and described herein.

The set of doses used in the trial is the collection of doses that was provided to at least one patient. Thus, a dose is implicitly a member of the set of doses. Consequently, the set of all OTUs in doses is defined as the unique set of OTUs such that each OTU is present in at least one dose.

As described herein, an engrafting OTU is an OTU that is not detectable in a patient, e.g., in their stool, pre-treatment, but is present in the composition delivered to the subject and is detected in the subject, (e.g., in the subject's stool) in at least one post-treatment sample from the subject. The set of all engrafting OTUs is defined as the unique set of engrafting OTUs found in at least one subject. An augmenting OTU is an OTU detected in a subject that is not engrafting and has an abundance ten times greater than the pre-treatment abundance at some post-treatment time point. The set of all augmenting OTUs is the unique set of augmenting OTUs found in at least one subject. The set of all augmenting and engrafting OTUs is defined as the unique set of OTUs that either augment or engraft in at least one subject.

The set of all unique ternary combinations can be generated from the experimentally derived set of OTUs by considering the all combinations of OTUs such that 1) each OTU of the ternary is different and 2) the three OTUs were not used together previously. A computer program can be used to generate such combinations.

Table 14 is generated from the set of all augmenting and engrafting OTUs and provides the OTUs that either were found to engraft or augment in at least one subject after they were treated with the composition. Each listed ternary combination is either in all doses provided to subjects or were detected together in all patients for at least one post-treatment time point. Typically, a useful composition includes at least one of the ternary compositions. In some embodiments, all three members of the ternary composition either engraft or augment in at least, e.g., 68%, 70%, 71%, 75%, 79%, 86%, 89%, 93%, or 100% of subjects. Because all subjects analyzed responded to treatment, the ternaries listed in the Table are useful in compositions for treatment of a dysbiosis.

Table 15 provides the list of unique ternary combinations of OTUs that were present in at least 95% of doses (rounding to the nearest integer) and that engrafted in at least one subject. Note that ternary combinations that were present in 100% of doses are listed in Table 14. Compositions that include a ternary combination are useful in compositions for treating a dysbiosis.

Table 16 provides the set of all unique ternary combinations of augmenting OTUs such that each ternary combination was detected in at least 75% of the subjects at a post-treatment time point.

Table 17 provides the set of all unique ternary combinations that were present in at least 75% of doses and for which the subject receiving the dose containing the ternary combination had *Clostridiales* sp. SM4/1 present as either an engrafting or augmenting OTU. Accordingly, in some embodiments, a composition consisting of, consisting essentially of, or comprising a ternary combination selected from Table 17 is useful for increasing *Clostridiales* sp. SM4/1 in a subject.

Table 18 provides the set of all unique ternary combinations generated from the set of all OTUs in doses such that each ternary is present at least 75% of the doses and for which the subject receiving the dose containing the ternary combination had *Clostridiales* sp. SSC/2 present as either an engrafting or augmenting OTU after treatment. Accordingly, in some embodiments, a composition consisting of, consisting essentially of, or comprising a ternary combination selected from Table 18 is useful for increasing *Clostridiales* sp. SSC/2 in a subject.

Table 19 provides the set of all unique ternary combinations generated from the set of all OTUs present in doses such that each ternary is present at least 75% of the doses and for which the subject to whom the doses containing the ternary combination was administered had *Clostridium* sp. NML 04A032 present as either an engrafting or augmenting OTU after treatment. Accordingly, in some embodiments, a composition consisting of, consisting essentially of, or comprising a ternary combination selected from Table 19 is useful for increasing *Clostridium* sp. NML 04A032 in a subject.

Table 20 provides the set of all unique ternary combinations generated from the set of all OTUs in doses such that the ternary is present at least 75% of the doses and for which the subject to whom the dose containing the ternary was administered had *Clostridium* sp. NML 04A032, *Ruminococcus lactaris*, and *Ruminococcus torques* present as either an engrafting or augmenting OTUs. Accordingly, in some embodiments, a composition consisting of, consisting essentially of, or comprising a ternary combination selected from Table 20 is useful for increasing *Clostridium* sp. NML 04A032, *Ruminococcus lactaris*, and *Ruminococcus torques* in a subject.

Table 21 shows the set of all unique ternary combinations generated from the set of all OTUs in doses such that each ternary is present at least 75% of the doses and for which the subject to whom the dose containing the ternary combination was administered has *Eubacterium rectale, Faecalibacterium prausnitzii, Oscillibacter* sp. G2, *Ruminococcus lactaris*, and *Ruminococcus torques* present as either an engrafting or augmenting OTU. Accordingly, in some embodiments, a composition consisting of, consisting essentially of, or comprising a ternary combination selected from Table 21 is useful for increasing *Eubacterium rectale, Faecalibacterium prausnitzii, Oscillibacter* sp. G2, *Ruminococcus lactaris*, and *Ruminococcus torques* in a subject.

Other embodiments will be apparent to those skilled in the art from consideration of the specification and practice of the embodiments. Consider the specification and examples as exemplary only, with a true scope and spirit being indicated by the following claims.

TABLES

TABLE 1

| OTU | SEQ ID Number | Public DB Accession | Phylogenetic Clade | Spore Former | Pathogen Status |
|---|---|---|---|---|---|
| *Corynebacterium coyleae* | 697 | X96497 | clade_100 | N | N |
| *Corynebacterium mucifaciens* | 711 | NR_026396 | clade_100 | N | N |
| *Corynebacterium ureicelerivorans* | 733 | AM397636 | clade_100 | N | N |
| *Corynebacterium appendicis* | 684 | NR_028951 | clade_102 | N | N |
| *Corynebacterium genitalium* | 698 | ACLJ01000031 | clade_102 | N | N |
| *Corynebacterium glaucum* | 699 | NR_028971 | clade_102 | N | N |
| *Corynebacterium imitans* | 703 | AF537597 | clade_102 | N | N |
| *Corynebacterium riegelii* | 719 | EU848548 | clade_102 | N | N |
| *Corynebacterium* sp. L_2012475 | 723 | HE575405 | clade_102 | N | N |
| *Corynebacterium* sp. NML 93_0481 | 724 | GU238409 | clade_102 | N | N |
| *Corynebacterium sundsvallense* | 728 | Y09655 | clade_102 | N | N |
| *Corynebacterium tuscaniae* | 730 | AY677186 | clade_102 | N | N |
| *Prevotella maculosa* | 1504 | AGEK01000035 | clade_104 | N | N |
| *Prevotella oris* | 1513 | ADDV01000091 | clade_104 | N | N |
| *Prevotella salivae* | 1517 | AB108826 | clade_104 | N | N |
| *Prevotella* sp. ICM55 | 1521 | HQ616399 | clade_104 | N | N |
| *Prevotella* sp. oral clone AA020 | 1528 | AY005057 | clade_104 | N | N |
| *Prevotella* sp. oral clone GI032 | 1538 | AY349396 | clade_104 | N | N |
| *Prevotella* sp. oral taxon G70 | 1558 | GU432179 | clade_104 | N | N |
| *Prevotella corporis* | 1491 | L16465 | clade_105 | N | N |
| *Bacteroides* sp. 4_1_36 | 312 | ACTC01000133 | clade_110 | N | N |
| *Bacteroides* sp. AR20 | 315 | AF139524 | clade_110 | N | N |
| *Bacteroides* sp. D20 | 319 | ACPT01000052 | clade_110 | N | N |
| *Bacteroides* sp. F_4 | 322 | AB470322 | clade_110 | N | N |
| *Bacteroides uniformis* | 329 | AB050110 | clade_110 | N | N |
| *Prevotella nanceiensis* | 1510 | JN867228 | clade_127 | N | N |
| *Prevotella* sp. oral taxon 299 | 1548 | ACWZ01000026 | clade_127 | N | N |
| *Prevotella bergensis* | 1485 | ACKS01000100 | clade_128 | N | N |
| *Prevotella buccalis* | 1489 | JN867261 | clade_129 | N | N |
| *Prevotella timonensis* | 1564 | ADEF01000012 | clade_129 | N | N |
| *Prevotella oralis* | 1512 | AEPE01000021 | clade_130 | N | N |
| *Prevotella* sp. SEQ072 | 1525 | JN867238 | clade_130 | N | N |
| *Leuconostoc carnosum* | 1177 | NR_040811 | clade_135 | N | N |
| *Leuconostoc gasicomitatum* | 1179 | FN822744 | clade_135 | N | N |
| *Leuconostoc inhae* | 1180 | NR_025204 | clade_135 | N | N |
| *Leuconostoc kimchii* | 1181 | NR_075014 | clade_135 | N | N |
| *Edwardsiella tarda* | 777 | CP002154 | clade_139 | N | N |
| *Photorhabdus asymbiotica* | 1466 | Z76752 | clade_139 | N | N |
| *Psychrobacter arcticus* | 1607 | CP000082 | clade_141 | N | N |
| *Psychrobacter cibarius* | 1608 | HQ698586 | clade_141 | N | N |
| *Psychrobacter cryohalolentis* | 1609 | CP000323 | clade_141 | N | N |
| *Psychrobacter faecalis* | 1610 | HQ698566 | clade_141 | N | N |
| *Psychrobacter nivimaris* | 1611 | HQ698587 | clade_141 | N | N |
| *Psychrobacter pulmonis* | 1612 | HQ698582 | clade_141 | N | N |
| *Pseudomonas aeruginosa* | 1592 | AABQ07000001 | clade_154 | N | N |
| *Pseudomonas* sp. 2_1_26 | 1600 | ACWU01000257 | clade_154 | N | N |
| *Corynebacterium confusum* | 691 | Y15886 | clade_158 | N | N |
| *Corynebacterium propinquum* | 712 | NR_037038 | clade_158 | N | N |
| *Corynebacterium pseudodiphtheriticum* | 713 | X84258 | clade_158 | N | N |
| *Bartonella bacilliformis* | 338 | NC_008783 | clade_159 | N | N |
| *Bartonella grahamii* | 339 | CP001562 | clade_159 | N | N |
| *Bartonella henselae* | 340 | NC_005956 | clade_159 | N | N |
| *Bartonella quintana* | 341 | BX897700 | clade_159 | N | N |
| *Bartonella tamiae* | 342 | EF672728 | clade_159 | N | N |
| *Bartonella washoensis* | 343 | FJ719017 | clade_159 | N | N |
| *Brucella abortus* | 430 | ACBJ01000075 | clade_159 | N | Category-B |
| *Brucella canis* | 431 | NR_044652 | clade_159 | N | Category-B |
| *Brucella ceti* | 432 | ACJD01000006 | clade_159 | N | Category-B |
| *Brucella melitensis* | 433 | AE009462 | clade_159 | N | Category-B |
| *Brucella microti* | 434 | NR_042549 | clade_159 | N | Category-B |
| *Brucella ovis* | 435 | NC_009504 | clade_159 | N | Category-B |
| *Brucella* sp. 83_13 | 436 | ACBQ01000040 | clade_159 | N | Category-B |
| *Brucella* sp. BO1 | 437 | EU053207 | clade_159 | N | Category-B |
| *Brucella suis* | 438 | ACBK01000034 | clade_159 | N | Category-B |
| *Ochrobactrum anthropi* | 1360 | NC_009667 | clade_159 | N | N |
| *Ochrobactrum intermedium* | 1361 | ACQA01000001 | clade_159 | N | N |
| *Ochrobactrum pseudintermedium* | 1362 | DQ365921 | clade_159 | N | N |
| *Prevotella* genomosp. C2 | 1496 | AY278625 | clade_164 | N | N |
| *Prevotella multisaccharivorax* | 1509 | AFJE01000016 | clade_164 | N | N |
| *Prevotella* sp. oral clone IDR_CEC_0055 | 1543 | AY550997 | clade_164 | N | N |
| *Prevotella* sp. oral taxon 292 | 1547 | GQ422735 | clade_164 | N | N |
| *Prevotella* sp. oral taxon 300 | 1549 | GU409549 | clade_164 | N | N |
| *Prevotella marshii* | 1505 | AEEI01000070 | clade_166 | N | N |
| *Prevotella* sp. oral clone IK053 | 1544 | AY349401 | clade_166 | N | N |

TABLE 1-continued

| OTU | SEQ ID Number | Public DB Accession | Phylogenetic Clade | Spore Former | Pathogen Status |
|---|---|---|---|---|---|
| *Prevotella* sp. oral taxon 781 | 1554 | GQ422744 | clade_166 | N | N |
| *Prevotella stercorea* | 1562 | AB244774 | clade_166 | N | N |
| *Prevotella brevis* | 1487 | NR_041954 | clade_167 | N | N |
| *Prevotella ruminicola* | 1516 | CP002006 | clade_167 | N | N |
| *Prevotella* sp. sp24 | 1560 | AB003384 | clade_167 | N | N |
| *Prevotella* sp. sp34 | 1561 | AB003385 | clade_167 | N | N |
| *Prevotella albensis* | 1483 | NR_025300 | clade_168 | N | N |
| *Prevotella copri* | 1490 | ACBX02000014 | clade_168 | N | N |
| *Prevotella oulorum* | 1514 | L16472 | clade_168 | N | N |
| *Prevotella* sp. BI_42 | 1518 | AJ581354 | clade_168 | N | N |
| *Prevotella* sp. oral clone P4PB_83 P2 | 1546 | AY207050 | clade_168 | N | N |
| *Prevotella* sp. oral taxon G60 | 1557 | GU432133 | clade_168 | N | N |
| *Prevotella amnii* | 1484 | AB547670 | clade_169 | N | N |
| *Bacteroides caccae* | 268 | EU136686 | clade_170 | N | N |
| *Bacteroides finegoldii* | 277 | AB222699 | clade_170 | N | N |
| *Bacteroides intestinalis* | 283 | ABJL02000006 | clade_171 | N | N |
| *Bacteroides* sp. XB44A | 326 | AM230649 | clade_171 | N | N |
| Bifidobacteriaceae genomsp. C1 | 345 | AY278612 | clade_172 | N | N |
| *Bifidobacterium adolescentis* | 346 | AAXD02000018 | clade_172 | N | N |
| *Bifidobacterium angulatum* | 347 | ABYS02000004 | clade_172 | N | N |
| *Bifidobacterium animalis* | 348 | CP001606 | clade_172 | N | N |
| *Bifidobacterium breve* | 350 | CP002743 | clade_172 | N | N |
| *Bifidobacterium catenulatum* | 351 | ABXY01000019 | clade_172 | N | N |
| *Bifidobacterium dentium* | 352 | CP001750 | clade_172 | N | OP |
| *Bifidobacterium gallicum* | 353 | ABXB03000004 | clade_172 | N | N |
| *Bifidobacterium infantis* | 354 | AY151398 | clade_172 | N | N |
| *Bifidobacterium kashiwanohense* | 355 | AB491757 | clade_172 | N | N |
| *Bifidobacterium longum* | 356 | ABQQ01000041 | clade_172 | N | N |
| *Bifidobacterium pseudocatenulatum* | 357 | ABXX02000002 | clade_172 | N | N |
| *Bifidobacterium pseudolongum* | 358 | NR_043442 | clade_172 | N | N |
| *Bifidobacterium scardovii* | 359 | AJ307005 | clade_172 | N | N |
| *Bifidobacterium* sp. HM2 | 360 | AB425276 | clade_172 | N | N |
| *Bifidobacterium* sp. HMLN12 | 361 | JF519685 | clade_172 | N | N |
| *Bifidobacterium* sp. M45 | 362 | HM626176 | clade_172 | N | N |
| *Bifidobacterium* sp. MSX5B | 363 | HQ616382 | clade_172 | N | N |
| *Bifidobacterium* sp. TM_7 | 364 | AB218972 | clade_172 | N | N |
| *Bifidobacterium thermophilum* | 365 | DQ340557 | clade_172 | N | N |
| *Leuconostoc citreum* | 1178 | AM157444 | clade_175 | N | N |
| *Leuconostoc lactis* | 1182 | NR_040823 | clade_175 | N | N |
| *Eubacterium saburreum* | 858 | AB525414 | clade_178 | Y | N |
| *Eubacterium* sp. oral clone IR009 | 866 | AY349376 | clade_178 | Y | N |
| Lachnospiraceae bacterium ICM62 | 1061 | HQ616401 | clade_178 | Y | N |
| Lachnospiraceae bacterium MSX33 | 1062 | HQ616384 | clade_178 | Y | N |
| Lachnospiraceae bacterium oral taxon 107 | 1063 | ADDS01000069 | clade_178 | Y | N |
| *Alicyclobacillus acidocaldarius* | 122 | NR_074721 | clade_179 | Y | N |
| *Alicyclobacillus acidoterrestris* | 123 | NR_040844 | clade_179 | N | N |
| *Alicyclobacillus cycloheptanicus* | 125 | NR_024754 | clade_179 | N | N |
| *Acinetobacter baumannii* | 27 | ACYQ01000014 | clade_181 | N | N |
| *Acinetobacter calcoaceticus* | 28 | AM157426 | clade_181 | N | N |
| *Acinetobacter* genomsp. C1 | 29 | AY278636 | clade_181 | N | N |
| *Acinetobacter haemolyticus* | 30 | ADMT01000017 | clade_181 | N | N |
| *Acinetobacter johnsonii* | 31 | ACPL01000162 | clade_181 | N | N |
| *Acinetobacter junii* | 32 | ACPM01000135 | clade_181 | N | N |
| *Acinetobacter lwoffii* | 33 | ACPN01000204 | clade_181 | N | N |
| *Acinetobacter parvus* | 34 | AIEB01000124 | clade_181 | N | N |
| *Acinetobacter schindleri* | 36 | NR_025412 | clade_181 | N | N |
| *Acinetobacter* sp. 56A1 | 37 | GQ178049 | clade_181 | N | N |
| *Acinetobacter* sp. CIP 101934 | 38 | JQ638573 | clade_181 | N | N |
| *Acinetobacter* sp. CIP 102143 | 39 | JQ638578 | clade_181 | N | N |
| *Acinetobacter* sp. M16_22 | 41 | HM366447 | clade_181 | N | N |
| *Acinetobacter* sp. RUH2624 | 42 | ACQF01000094 | clade_181 | N | N |
| *Acinetobacter* sp. SH024 | 43 | ADCH01000068 | clade_181 | N | N |
| *Lactobacillus jensenii* | 1092 | ACQD01000066 | clade_182 | N | N |
| *Alcaligenes faecalis* | 119 | AB680368 | clade_183 | N | N |
| *Alcaligenes* sp. CO14 | 120 | DQ643040 | clade_183 | N | N |
| *Alcaligenes* sp. S3 | 121 | HQ262549 | clade_183 | N | N |
| *Oligella ureolytica* | 1366 | NR_041998 | clade_183 | N | N |
| *Oligella urethralis* | 1367 | NR_041753 | clade_183 | N | N |
| *Eikenella corrodens* | 784 | ACEA01000028 | clade_185 | N | N |
| *Kingella denitrificans* | 1019 | AEWV01000047 | clade_185 | N | N |
| *Kingella* genomsp. P1 oral cone MB2_C20 | 1020 | DQ003616 | clade_185 | N | N |
| *Kingella kingae* | 1021 | AFHS01000073 | clade_185 | N | N |
| *Kingella oralis* | 1022 | ACJW02000005 | clade_185 | N | N |
| *Kingella* sp. oral clone ID059 | 1023 | AY349381 | clade_185 | N | N |

TABLE 1-continued

| OTU | SEQ ID Number | Public DB Accession | Phylogenetic Clade | Spore Former | Pathogen Status |
|---|---|---|---|---|---|
| *Neisseria elongate* | 1330 | ADBF01000003 | clade_185 | N | N |
| *Neisseria* genomosp. P2 oral clone MB5_P15 | 1332 | DQ003630 | clade_185 | N | N |
| *Neisseria* sp. oral clone JC012 | 1345 | AY349388 | clade_185 | N | N |
| *Neisseria* sp. SMC A9199 | 1342 | FJ763637 | clade_185 | N | N |
| *Simonsiella muelleri* | 1731 | ADCY01000105 | clade_185 | N | N |
| *Corynebacterium glucuronolyticum* | 700 | ABYP01000081 | clade_193 | N | N |
| *Corynebacterium pyruviciproducens* | 716 | FJ185225 | clade_193 | N | N |
| *Rothia aeria* | 1649 | DQ673320 | clade_194 | N | N |
| *Rothia dentocariosa* | 1650 | ADDW01000024 | clade_194 | N | N |
| *Rothia* sp. oral taxon 188 | 1653 | GU470892 | clade_194 | N | N |
| *Corynebacterium accolens* | 681 | ACGD01000048 | clade_195 | N | N |
| *Corynebacterium macginleyi* | 707 | AB359393 | clade_195 | N | N |
| *Corynebacterium pseudogenitalium* | 714 | ABYQ01000237 | clade_195 | N | N |
| *Corynebacterium tuberculostearicum* | 729 | ACVP01000009 | clade_195 | N | N |
| *Lactobacillus casei* | 1074 | CP000423 | clade_198 | N | N |
| *Lactobacillus paracasei* | 1106 | ABQV01000067 | clade_198 | N | N |
| *Lactobacillus zeae* | 1143 | NR_037122 | clade_198 | N | N |
| *Prevotella dentalis* | 1492 | AB547678 | clade_205 | N | N |
| *Prevotella* sp. oral clone ASCG10 | 1529 | AY923148 | clade_206 | N | N |
| *Prevotella* sp. oral clone HF050 | 1541 | AY349399 | clade_206 | N | N |
| *Prevotella* sp. oral clone ID019 | 1542 | AY349400 | clade_206 | N | N |
| *Prevotella* sp. oral clone IK062 | 1545 | AY349402 | clade_206 | N | N |
| *Prevotella* genomosp. P9 oral clone MB7_G16 | 1499 | DQ003633 | clade_207 | N | N |
| *Prevotella* sp. oral clone AU069 | 1531 | AY005062 | clade_207 | N | N |
| *Prevotella* sp. oral clone CY006 | 1532 | AY005063 | clade_207 | N | N |
| *Prevotella* sp. oral clone FL019 | 1534 | AY349392 | clade_207 | N | N |
| *Actinomyces* genomosp. C1 | 56 | AY278610 | clade_212 | N | N |
| *Actinomyces* genomosp. C2 | 57 | AY278611 | clade_212 | N | N |
| *Actinomyces* genomosp. P1 oral clone MB6_C03 | 58 | DQ003632 | clade_212 | N | N |
| *Actinomyces georgiae* | 59 | GU561319 | clade_212 | N | N |
| *Actinomyces israelii* | 60 | AF479270 | clade_212 | N | N |
| *Actinomyces massiliensis* | 61 | AB545934 | clade_212 | N | N |
| *Actinomyces meyeri* | 62 | GU561321 | clade_212 | N | N |
| *Actinomyces odontolyticus* | 66 | ACYT01000123 | clade_212 | N | N |
| *Actinomyces orihominis* | 68 | AJ575186 | clade_212 | N | N |
| *Actinomyces* sp. CCUG 37290 | 71 | AJ234058 | clade_212 | N | N |
| *Actinomyces* sp. ICM34 | 75 | HQ616391 | clade_212 | N | N |
| *Actinomyces* sp. ICM41 | 76 | HQ616392 | clade_212 | N | N |
| *Actinomyces* sp. ICM47 | 77 | HQ616395 | clade_212 | N | N |
| *Actinomyces* sp. ICM54 | 78 | HQ616398 | clade_212 | N | N |
| *Actinomyces* sp. oral clone IP081 | 87 | AY349366 | clade_212 | N | N |
| *Actinomyces* sp. oral taxon 178 | 91 | AEUH01000060 | clade_212 | N | N |
| *Actinomyces* sp. oral taxon 180 | 92 | AEPP01000041 | clade_212 | N | N |
| *Actinomyces* sp. TeJ5 | 80 | GU561315 | clade_212 | N | N |
| *Haematobacter* sp. BC14248 | 968 | GU396991 | clade_213 | N | N |
| *Paracoccus denitrificans* | 1424 | CP000490 | clade_213 | N | N |
| *Paracoccus marcusii* | 1425 | NR_044922 | clade_213 | N | N |
| *Grimontia hollisae* | 967 | ADAQ01000013 | clade_216 | N | N |
| *Shewanella putrefaciens* | 1723 | CP002457 | clade_216 | N | N |
| *Afipia* genomosp. 4 | 111 | EU117385 | clade_217 | N | N |
| *Rhodopseudomonas palustris* | 1626 | CP000301 | clade_217 | N | N |
| *Methylobacterium extorquens* | 1223 | NC_010172 | clade_218 | N | N |
| *Methylobacterium podarium* | 1224 | AY468363 | clade_218 | N | N |
| *Methylobacterium radiotolerans* | 1225 | GU294320 | clade_218 | N | N |
| *Methylobacterium* sp. 1sub | 1226 | AY468371 | clade_218 | N | N |
| *Methylobacterium* sp. MM4 | 1227 | AY468370 | clade_218 | N | N |
| *Clostridium baratii* | 555 | NR_029229 | clade_223 | Y | N |
| *Clostridium colicanis* | 576 | FJ957863 | clade_223 | Y | N |
| *Clostridium paraputrificum* | 611 | AB536771 | clade_223 | Y | N |
| *Clostridium sardiniense* | 621 | NR_041006 | clade_223 | Y | N |
| *Eubacterium budayi* | 837 | NR_024682 | clade_223 | Y | N |
| *Eubacterium moniliforme* | 851 | HF558373 | clade_223 | Y | N |
| *Eubacterium multiforme* | 852 | NR_024683 | clade_223 | Y | N |
| *Eubacterium nitritogenes* | 853 | NR_024684 | clade_223 | Y | N |
| *Achromobacter denitrificans* | 18 | NR_042021 | clade_224 | N | N |
| *Achromobacter piechaudii* | 19 | ADMS01000149 | clade_224 | N | N |
| *Achromobacter xylosoxidans* | 20 | ACRC01000072 | clade_224 | N | N |
| *Bordetella bronchiseptica* | 384 | NR_025949 | clade_224 | N | OP |
| *Bordetella holmesii* | 385 | AB683187 | clade_224 | N | OP |
| *Bordetella parapertussis* | 386 | NR_025950 | clade_224 | N | OP |
| *Bordetella pertussis* | 387 | BX640418 | clade_224 | N | OP |
| *Microbacterium chocolatum* | 1230 | NR_037045 | clade_225 | N | N |
| *Microbacterium flavescens* | 1231 | EU714363 | clade_225 | N | N |
| *Microbacterium lacticum* | 1233 | EU714351 | clade_225 | N | N |

TABLE 1-continued

| OTU | SEQ ID Number | Public DB Accession | Phylogenetic Clade | Spore Former | Pathogen Status |
|---|---|---|---|---|---|
| *Microbacterium oleivorans* | 1234 | EU714381 | clade_225 | N | N |
| *Microbacterium oxydans* | 1235 | EU714348 | clade_225 | N | N |
| *Microbacterium paraoxydans* | 1236 | AJ491806 | clade_225 | N | N |
| *Microbacterium phyllosphaerae* | 1237 | EU714359 | clade_225 | N | N |
| *Microbacterium schleiferi* | 1238 | NR_044936 | clade_225 | N | N |
| *Microbacterium* sp. 768 | 1239 | EU714378 | clade_225 | N | N |
| *Microbacterium* sp. oral strain C24KA | 1240 | AF287752 | clade_225 | N | N |
| *Microbacterium testaceum* | 1241 | EU714365 | clade_225 | N | N |
| *Corynebacterium atypicum* | 686 | NR_025540 | clade_229 | N | N |
| *Corynebacterium mastitidis* | 708 | AB359395 | clade_229 | N | N |
| *Corynebacterium* sp. NML 97_0186 | 725 | GU238411 | clade_229 | N | N |
| *Mycobacterium elephantis* | 1275 | AF385898 | clade_237 | N | OP |
| *Mycobacterium parraterrae* | 1288 | EU919229 | clade_237 | N | OP |
| *Mycobacterium phlei* | 1289 | GU142920 | clade_237 | N | OP |
| *Mycobacterium* sp. 1776 | 1293 | EU703152 | clade_237 | N | N |
| *Mycobacterium* sp. 1781 | 1294 | EU703147 | clade_237 | N | N |
| *Mycobacterium* sp. AQ1GA4 | 1297 | HM210417 | clade_237 | N | N |
| *Mycobacterium* sp. GN_10546 | 1299 | FJ497243 | clade_237 | N | N |
| *Mycobacterium* sp. GN_10827 | 1300 | FJ497247 | clade_237 | N | N |
| *Mycobacterium* sp. GN_11124 | 1301 | FJ652846 | clade_237 | N | N |
| *Mycobacterium* sp. GN_9188 | 1302 | FJ497240 | clade_237 | N | N |
| *Mycobacterium* sp. GR_2007_210 | 1303 | FJ555538 | clade_237 | N | N |
| *Anoxybacillus contaminans* | 172 | NR_029006 | clade_238 | N | N |
| *Anoxybacillus flavithermus* | 173 | NR_074667 | clade_238 | Y | N |
| *Bacillus aeolius* | 195 | NR_025557 | clade_238 | N | N |
| *Bacillus aerophilus* | 196 | NR_042339 | clade_238 | Y | N |
| *Bacillus aestuarii* | 197 | GQ980243 | clade_238 | Y | N |
| *Bacillus amyloliquefaciens* | 199 | NR_075005 | clade_238 | Y | N |
| *Bacillus anthracis* | 200 | AAEN01000020 | clade_238 | Y | Category-A |
| *Bacillus atrophaeus* | 201 | NR_075016 | clade_238 | Y | OP |
| *Bacillus badius* | 202 | NR_036893 | clade_238 | Y | OP |
| *Bacillus cereus* | 203 | ABDJ01000015 | clade_238 | Y | OP |
| *Bacillus circulans* | 204 | AB271747 | clade_238 | Y | OP |
| *Bacillus firmus* | 207 | NR_025842 | clade_238 | Y | OP |
| *Bacillus flexus* | 208 | NR_024691 | clade_238 | Y | OP |
| *Bacillus fordii* | 209 | NR_025786 | clade_238 | Y | OP |
| *Bacillus halmapalus* | 211 | NR_026144 | clade_238 | Y | OP |
| *Bacillus herbersteinensis* | 213 | NR_042286 | clade_238 | Y | OP |
| *Bacillus idriensis* | 215 | NR_043268 | clade_238 | Y | OP |
| *Bacillus lentus* | 216 | NR_040792 | clade_238 | Y | OP |
| *Bacillus licheniformis* | 217 | NC_006270 | clade_238 | Y | OP |
| *Bacillus megaterium* | 218 | GU252124 | clade_238 | Y | OP |
| *Bacillus nealsonii* | 219 | NR_044546 | clade_238 | Y | OP |
| *Bacillus niabensis* | 220 | NR_043334 | clade_238 | Y | OP |
| *Bacillus niacini* | 221 | NR_024695 | clade_238 | Y | OP |
| *Bacillus pocheonensis* | 222 | NR_041377 | clade_238 | Y | OP |
| *Bacillus pumilus* | 223 | NR_074977 | clade_238 | Y | OP |
| *Bacillus safensis* | 224 | JQ624766 | clade_238 | Y | OP |
| *Bacillus simplex* | 225 | NR_042136 | clade_238 | Y | OP |
| *Bacillus sonorensis* | 226 | NR_025130 | clade_238 | Y | OP |
| *Bacillus* sp. 10403023 MM10403188 | 227 | CAET10000089 | clade_238 | Y | OP |
| *Bacillus* sp. 2_A_57_CT2 | 230 | ACWD01000095 | clade_238 | Y | OP |
| *Bacillus* sp. 2008724126 | 228 | GU252108 | clade_238 | Y | OP |
| *Bacillus* sp. 2008724139 | 229 | GU252111 | clade_238 | Y | OP |
| *Bacillus* sp. 7_16AIA | 231 | FN397518 | clade_238 | Y | OP |
| *Bacillus* sp. AP8 | 233 | JX101689 | clade_238 | Y | OP |
| *Bacillus* sp. B27(2008) | 234 | EU362173 | clade_238 | Y | OP |
| *Bacillus* sp. BT1B_CT2 | 235 | ACWC01000034 | clade_238 | Y | OP |
| *Bacillus* sp. GB1.1 | 236 | FJ897765 | clade_238 | Y | OP |
| *Bacillus* sp. GB9 | 237 | FJ897766 | clade_238 | Y | OP |
| *Bacillus* sp. HU19.1 | 238 | FJ897769 | clade_238 | Y | OP |
| *Bacillus* sp. HU29 | 239 | FJ897771 | clade_238 | Y | OP |
| *Bacillus* sp. HU33.1 | 240 | FJ897772 | clade_238 | Y | OP |
| *Bacillus* sp. JC6 | 241 | JF824800 | clade_238 | Y | OP |
| *Bacillus* sp. oral taxon F79 | 248 | HM099654 | clade_238 | Y | OP |
| *Bacillus* sp. SRC_DSF1 | 243 | GU797283 | clade_238 | Y | OP |
| *Bacillus* sp. SRC_DSF10 | 242 | GU797292 | clade_238 | Y | OP |
| *Bacillus* sp. SRC_DSF2 | 244 | GU797284 | clade_238 | Y | OP |
| *Bacillus* sp. SRC_DSF6 | 245 | GU797288 | clade_238 | Y | OP |
| *Bacillus* sp. tc09 | 249 | HQ844242 | clade_238 | Y | OP |
| *Bacillus* sp. zh168 | 250 | FJ851424 | clade_238 | Y | OP |
| *Bacillus sphaericus* | 251 | DQ286318 | clade_238 | Y | OP |
| *Bacillus sporothermodurans* | 252 | NR_026010 | clade_238 | Y | OP |
| *Bacillus subtilis* | 253 | EU627588 | clade_238 | Y | OP |
| *Bacillus thermoamylovorans* | 254 | NR_029151 | clade_238 | Y | OP |
| *Bacillus thuringiensis* | 255 | NC_008600 | clade_238 | Y | OP |
| *Bacillus weihenstephanensis* | 256 | NR_074926 | clade_238 | Y | OP |

TABLE 1-continued

| OTU | SEQ ID Number | Public DB Accession | Phylogenetic Clade | Spore Former | Pathogen Status |
|---|---|---|---|---|---|
| *Brevibacterium frigoritolerans* | 422 | NR_042639 | clade_238 | N | N |
| *Geobacillus kaustophilus* | 933 | NR_074989 | clade_238 | Y | N |
| *Geobacillus* sp. E263 | 934 | DQ647387 | clade_238 | N | N |
| *Geobacillus* sp. WCH70 | 935 | CP001638 | clade_238 | N | N |
| *Geobacillus stearothermophilus* | 936 | NR_040794 | clade_238 | Y | N |
| *Geobacillus thermocatenulatus* | 937 | NR_043020 | clade_238 | N | N |
| *Geobacillus thermodenitrificans* | 938 | NR_074976 | clade_238 | Y | N |
| *Geobacillus thermoglucosidasius* | 939 | NR_043022 | clade_238 | Y | N |
| *Geobacillus thermoleovorans* | 940 | NR_074931 | clade_238 | N | N |
| *Lysinibacillus fusiformis* | 1192 | FN397522 | clade_238 | N | N |
| *Lysinibacillus sphaericus* | 1193 | NR_074883 | clade_238 | Y | N |
| *Planomicrobium koreense* | 1468 | NR_025011 | clade_238 | N | N |
| *Sporosarcina newyorkensis* | 1754 | AFPZ01000142 | clade_238 | N | N |
| *Sporosarcina* sp. 2681 | 1755 | GU994081 | clade_238 | N | N |
| *Ureibacillus composti* | 1968 | NR_043746 | clade_238 | N | N |
| *Ureibacillus suwonensis* | 1969 | NR_043232 | clade_238 | N | N |
| *Ureibacillus terrenus* | 1970 | NR_025394 | clade_238 | N | N |
| *Ureibacillus thermophilus* | 1971 | NR_043747 | clade_238 | N | N |
| *Ureibacillus thermosphaericus* | 1972 | NR_040961 | clade_238 | N | N |
| *Prevotella micans* | 1507 | AGWK01000061 | clade_239 | N | N |
| *Prevotella* sp. oral clone DA058 | 1533 | AY005065 | clade_239 | N | N |
| *Prevotella* sp. SEQ053 | 1523 | JN867222 | clade_239 | N | N |
| *Treponema socranskii* | 1937 | NR_024868 | clade_240 | N | OP |
| *Treponema* sp. 6:H:D15A_4 | 1938 | AY005083 | clade_240 | N | N |
| *Treponema* sp. oral taxon 265 | 1953 | GU408850 | clade_240 | N | N |
| *Treponema* sp. oral taxon G85 | 1958 | GU432215 | clade_240 | N | N |
| *Porphyromonas endodontalis* | 1472 | ACNN01000021 | clade_241 | N | N |
| *Porphyromonas* sp. oral clone BB134 | 1478 | AY005068 | clade_241 | N | N |
| *Porphyromonas* sp. oral clone F016 | 1479 | AY005069 | clade_241 | N | N |
| *Porphyromonas* sp. oral clone P2PB_52 P1 | 1480 | AY207054 | clade_241 | N | N |
| *Porphyromonas* sp. oral clone P4GB_100 P2 | 1481 | AY207057 | clade_241 | N | N |
| *Acidovorax* sp. 98_63833 | 26 | AY258065 | clade_245 | N | N |
| Comamonadaceae bacterium NML000135 | 663 | JN585335 | clade_245 | N | N |
| Comamonadaceae bacterium NML790751 | 664 | JN585331 | clade_245 | N | N |
| Comamonadaceae bacterium NML910035 | 665 | JN585332 | clade_245 | N | N |
| Comamonadaceae bacterium NML910036 | 666 | JN585333 | clade_245 | N | N |
| *Comamonas* sp. NSP5 | 668 | AB076850 | clade_245 | N | N |
| *Delftia acidovorans* | 748 | CP000884 | clade_245 | N | N |
| *Xenophilus aerolatus* | 2018 | JN585329 | clade_245 | N | N |
| Clostridiales sp. SS3/4 | 543 | AY305316 | clade_246 | Y | N |
| *Oribacfcerium* sp. oral taxon 078 | 1380 | ACIQ02000009 | clade_246 | N | N |
| *Oribacterium* sp. oral taxon 102 | 1381 | GQ422713 | clade_246 | N | N |
| *Weissella cibaria* | 2007 | NR_036924 | clade_247 | N | N |
| *Weissella confusa* | 2008 | NR_040816 | clade_247 | N | N |
| *Weissella hellenica* | 2009 | AB680902 | clade_247 | N | N |
| *Weissella kandleri* | 2010 | NR_044659 | clade_247 | N | N |
| *Weissella koreensis* | 2011 | NR_075058 | clade_247 | N | N |
| *Weissella paramesenteroides* | 2012 | ACKU01000017 | clade_247 | N | N |
| *Weissella* sp. KLDS 7.0701 | 2013 | EU600924 | clade_247 | N | N |
| *Mobiluncus curtisii* | 1251 | AEPZ01000013 | clade_249 | N | N |
| *Clostridium beijerinckii* | 557 | NR_074434 | clade_252 | Y | N |
| *Clostridium botulinum* | 560 | NC_010723 | clade_252 | Y | Category-A |
| *Clostridium butyricum* | 561 | ABDT01000017 | clade_252 | Y | N |
| *Clostridium chauvoei* | 568 | EU106372 | clade_252 | Y | N |
| *Clostridium favososporum* | 582 | X76749 | clade_252 | Y | N |
| *Clostridium histolyticum* | 592 | HF558362 | clade_252 | Y | N |
| *Clostridium isatidis* | 597 | NR_026347 | clade_252 | Y | N |
| *Clostridium limosum* | 602 | FR870444 | clade_252 | Y | N |
| *Clostridium sartagoforme* | 622 | NR_026490 | clade_252 | Y | N |
| *Clostridium septicum* | 624 | NR_026020 | clade_252 | Y | N |
| *Clostridium* sp. 7_2_43FAA | 626 | ACDK01000101 | clade_252 | Y | N |
| *Clostridium sporogenes* | 645 | ABKW02000003 | clade_252 | Y | N |
| *Clostridium tertium* | 653 | Y18174 | clade_252 | Y | N |
| *Clostridium carnis* | 564 | NR_044716 | clade_253 | Y | N |
| *Clostridium celatum* | 565 | X77844 | clade_253 | Y | N |
| *Clostridium disporicum* | 579 | NR_026491 | clade_253 | Y | N |
| *Clostridium gasigenes* | 585 | NR_024945 | clade_253 | Y | N |
| *Clostridium quinii* | 616 | NR_026149 | clade_253 | Y | N |
| *Enhydrobacter aerosaccus* | 785 | ACYI01000081 | clade_256 | N | N |
| *Moraxella osloensis* | 1262 | JN175341 | clade_256 | N | N |
| *Moraxella* sp. GM2 | 1264 | JF837191 | clade_256 | N | N |
| *Brevibacterium casei* | 420 | JF951998 | clade_257 | N | N |
| *Brevibacterium epidermidis* | 421 | NR_029262 | clade_257 | N | N |
| *Brevibacterium sanguinis* | 426 | NR_028016 | clade_257 | N | N |
| *Brevibacterium* sp. H15 | 427 | AB177640 | clade_257 | N | N |
| *Clostridium hylemonae* | 593 | AB023973 | clade_260 | Y | N |

TABLE 1-continued

| OTU | SEQ ID Number | Public DB Accession | Phylogenetic Clade | Spore Former | Pathogen Status |
|---|---|---|---|---|---|
| *Clostridium scindens* | 623 | AF262238 | clade__260 | Y | N |
| *Lachnospiraceae* bacterium 5_1_57FAA | 1054 | ACTR01000020 | clade__260 | Y | N |
| *Acinetobacter radioresistens* | 35 | ACVR01000010 | clade__261 | N | N |
| *Clostridium glycyrrhizinilyticum* | 588 | AB233029 | clade__262 | Y | N |
| *Clostridium nexile* | 607 | X73443 | clade__262 | Y | N |
| *Coprococcus comes* | 674 | ABVR01000038 | clade__262 | Y | N |
| *Lachnospiraceae* bacterium 1_1_57FAA | 1048 | ACTM01000065 | clade__262 | Y | N |
| *Lachnospiraceae* bacterium 1_4_56FAA | 1049 | ACTN01000028 | clade__262 | Y | N |
| *Lachnospiraceae* bacterium 8_1_57FAA | 1057 | ACWQ01000079 | clade__262 | Y | N |
| *Ruminococcus lactaris* | 1663 | ABOU02000049 | clade__262 | Y | N |
| *Ruminococcus torques* | 1670 | AAVP02000002 | clade__262 | Y | N |
| *Lactobacillus alimentarius* | 1068 | NR_044701 | clade__263 | N | N |
| *Lactobacillus farciminis* | 1082 | NR_044707 | clade__263 | N | N |
| *Lactobacillus kimchii* | 1097 | NR_025045 | clade__263 | N | N |
| *Lactobacillus nodensis* | 1101 | NR_041629 | clade__263 | N | N |
| *Lactobacillus tucceti* | 1138 | NR_042194 | clade__263 | N | N |
| *Pseudomonas mendocina* | 1595 | AAUL01000021 | clade__265 | N | N |
| *Pseudomonas pseudoalcaligenes* | 1598 | NR_037000 | clade__265 | N | N |
| *Pseudomonas* sp. NP522b | 1602 | EU723211 | clade__265 | N | N |
| *Pseudomonas stutzeri* | 1603 | AM905854 | clade__265 | N | N |
| *Paenibacillus barcinonensis* | 1390 | NR_042272 | clade__270 | N | N |
| *Paenibacillus barengoltzii* | 1391 | NR_042756 | clade__270 | N | N |
| *Paenibacillus chibensis* | 1392 | NR_040885 | clade__270 | N | N |
| *Paenibacillus cookii* | 1393 | NR_025372 | clade__270 | N | N |
| *Paenibacillus durus* | 1394 | NR_037017 | clade__270 | N | N |
| *Paenibacillus glucanolyticus* | 1395 | D78470 | clade__270 | N | N |
| *Paenibacillus lactis* | 1396 | NR_025739 | clade__270 | N | N |
| *Paenibacillus lautus* | 1397 | NR_040882 | clade__270 | Y | N |
| *Paenibacillus pabuli* | 1398 | NR_040853 | clade__270 | N | N |
| *Paenibacillus polymyxa* | 1399 | NR_037006 | clade__270 | Y | N |
| *Paenibacillus popilliae* | 1400 | NR_040888 | clade__270 | N | N |
| *Paenibacillus* sp. CIP 101062 | 1401 | HM212646 | clade__270 | N | N |
| *Paenibacillus* sp. HGF5 | 1402 | AEXS01000095 | clade__270 | Y | N |
| *Paenibacillus* sp. HGF7 | 1403 | AFDH01000147 | clade__270 | Y | N |
| *Paenibacillus* sp. JC66 | 1404 | JF824808 | clade__270 | N | N |
| *Paenibacillus* sp. R_27413 | 1405 | HE586333 | clade__270 | N | N |
| *Paenibacillus* sp. R_27422 | 1406 | HE586338 | clade__270 | N | N |
| *Paenibacillus timonensis* | 1408 | NR_042844 | clade__270 | N | N |
| *Rothia mucilaginosa* | 1651 | ACVO01000020 | clade__271 | N | N |
| *Rothia nasimurium* | 1652 | NR_025310 | clade__271 | N | N |
| *Prevotella* sp. oral taxon 302 | 1550 | ACZK01000043 | clade__280 | N | N |
| *Prevotella* sp. oral taxon F68 | 1556 | HM099652 | clade__280 | N | N |
| *Prevotella tannerae* | 1563 | ACIJ02000018 | clade__280 | N | N |
| Prevotellaceae bacterium P4P_62 P1 | 1566 | AY207061 | clade__280 | N | N |
| *Porphyromonas asaccharolytica* | 1471 | AENO01000048 | clade__281 | N | N |
| *Porphyromonas gingivails* | 1473 | AE015924 | clade__281 | N | N |
| *Porphyromonas macacae* | 1475 | NR_025908 | clade__281 | N | N |
| *Porphyromonas* sp. UQD 301 | 1477 | EU012301 | clade__281 | N | N |
| *Porphyromonas uenonis* | 1482 | ACLR01000152 | clade__281 | N | N |
| *Leptotrichia buccalis* | 1165 | CP001685 | clade__282 | N | N |
| *Leptotrichia hofstadii* | 1168 | ACVB02000032 | clade__282 | N | N |
| *Leptotrichia* sp. oral clone HE012 | 1173 | AY349386 | clade__282 | N | N |
| *Leptotrichia* sp. oral taxon 223 | 1176 | GU408547 | clade__282 | N | N |
| *Bacteroides fluxus* | 278 | AFBN01000029 | clade__285 | N | N |
| *Bacteroides helcogenes* | 281 | CP002352 | clade__285 | N | N |
| *Parabacteroides johnsonii* | 1419 | ABYH01000014 | clade__286 | N | N |
| *Parabacteroides merdae* | 1420 | EU136685 | clade__286 | N | N |
| *Treponema denticola* | 1926 | ADEC01000002 | clade__288 | N | OP |
| *Treponema* genomosp. P5 oral clone MB3_P23 | 1929 | DQ003624 | clade__288 | N | N |
| *Treponema putidum* | 1935 | AJ543428 | clade__288 | N | OP |
| *Treponema* sp. oral clone P2PB_53 P3 | 1942 | AY207055 | clade__288 | N | N |
| *Treponema* sp. oral taxon 247 | 1949 | GU408748 | clade__288 | N | N |
| *Treponema* sp. oral taxon 250 | 1950 | GU408776 | clade__288 | N | N |
| *Treponema* sp. oral taxon 251 | 1951 | GU408781 | clade__288 | N | N |
| *Anaerococcus hydrogenalis* | 144 | ABXA01000039 | clade__289 | N | N |
| *Anaerococcus* sp. 8404299 | 148 | HM587318 | clade__289 | N | N |
| *Anaerococcus* sp. gpac215 | 156 | AM176540 | clade__289 | N | N |
| *Anaerococcus vaginalis* | 158 | ACXU01000016 | clade__289 | N | N |
| *Propionibacterium acidipropionici* | 1569 | NC_019395 | clade__290 | N | N |
| *Propionibacterium avidum* | 1571 | AJ003055 | clade__290 | N | N |
| *Propionibacterium granulosum* | 1573 | FJ785716 | clade__290 | N | N |
| *Propionibacterium jensenii* | 1574 | NR_042269 | clade__290 | N | N |
| *Propionibacterium propionicum* | 1575 | NR_025277 | clade__290 | N | N |
| *Propionibacterium* sp. H456 | 1577 | AB177643 | clade__290 | N | N |
| *Propionibacterium thoenii* | 1581 | NR_042270 | clade__290 | N | N |
| *Bifidobacterium bifidum* | 349 | ABQP01000027 | clade__293 | N | N |

TABLE 1-continued

| OTU | SEQ ID Number | Public DB Accession | Phylogenetic Clade | Spore Former | Pathogen Status |
|---|---|---|---|---|---|
| *Leuconostoc mesenteroides* | 1183 | ACKV01000113 | clade__295 | N | N |
| *Leuconostoc pseudomesenteroides* | 1184 | NR__040814 | clade__295 | N | N |
| *Eubacterium* sp. oral clone JI012 | 868 | AY349379 | clade__298 | Y | N |
| *Johnsonella ignava* | 1016 | X87152 | clade__298 | N | N |
| *Propionibacterium acnes* | 1570 | ADJM01000010 | clade__299 | N | N |
| *Propionibacterium* sp. 434__HC2 | 1576 | AFIL01000035 | clade__299 | N | N |
| *Propionibacterium* sp. LG | 1578 | AY354921 | clade__299 | N | N |
| *Propionibacterium* sp. S555a | 1579 | AB264622 | clade__299 | N | N |
| *Alicyclobacillus contaminans* | 124 | NR__041475 | clade__301 | Y | N |
| *Alicyclobacillus herbarius* | 126 | NR__024753 | clade__301 | Y | N |
| *Alicyclobacillus pomorum* | 127 | NR__024801 | clade__301 | Y | N |
| *Alicyclobacillus* sp. CCUG 53762 | 128 | HE613268 | clade__301 | N | N |
| *Actinomyces cardiffensis* | 53 | GU470888 | clade__303 | N | N |
| *Actinomyces funkei* | 55 | HQ906497 | clade__303 | N | N |
| *Actinomyces* sp. HKU31 | 74 | HQ335393 | clade__303 | N | N |
| *Actinomyces* sp. oral taxon C55 | 94 | HM099646 | clade__303 | N | N |
| *Kerstersia gyiorum* | 1018 | NR__025669 | clade__307 | N | N |
| *Pigmentiphaga daeguensis* | 1467 | JN585327 | clade__307 | N | N |
| *Aeromonas allosaccharophila* | 104 | S39232 | clade__308 | N | N |
| *Aeromonas enteropelogenes* | 105 | X71121 | clade__308 | N | N |
| *Aeromonas hydrophila* | 106 | NC__008570 | clade__308 | N | N |
| *Aeromonas jandaei* | 107 | X60413 | clade__308 | N | N |
| *Aeromonas salmonicida* | 108 | NC__009348 | clade__308 | N | N |
| *Aeromonas trota* | 109 | X60415 | clade__308 | N | N |
| *Aeromonas veronii* | 110 | NR__044845 | clade__308 | N | N |
| *Blautia coccoides* | 373 | AB571656 | clade__309 | Y | N |
| *Blautia glucerasea* | 374 | AB588023 | clade__309 | Y | N |
| *Blautia glucerasei* | 375 | AB439724 | clade__309 | Y | N |
| *Blautia hansenii* | 376 | ABYU02000037 | clade__309 | Y | N |
| *Blautia luti* | 378 | AB691576 | clade__309 | Y | N |
| *Blautia producta* | 379 | AB600998 | clade__309 | Y | N |
| *Blautia schinkii* | 380 | NR__026312 | clade__309 | Y | N |
| *Blautia* sp. M25 | 381 | HM626178 | clade__309 | Y | N |
| *Blautia stercoris* | 382 | HM626177 | clade__309 | Y | N |
| *Blautia wexlerae* | 383 | EF036467 | clade__309 | Y | N |
| *Bryantella formatexigens* | 439 | ACCL02000018 | clade__309 | Y | N |
| *Clostridium coccoides* | 573 | EF025906 | clade__309 | Y | N |
| *Eubacterium cellulosolvens* | 839 | AY178842 | clade__309 | Y | N |
| *Lachnospiraceae bacterium* 6__1__63FAA | 1056 | ACTV01000014 | clade__309 | Y | N |
| *Marvinbryantia formatexigens* | 1196 | AJ505973 | clade__309 | N | N |
| *Ruminococcus hansenii* | 1662 | M59114 | clade__309 | Y | N |
| *Ruminococcus obeum* | 1664 | AY169419 | clade__309 | Y | N |
| *Ruminococcus* sp. 5__1__39BFAA | 1666 | ACII01000172 | clade__309 | Y | N |
| *Ruminococcus* sp. K__1 | 1669 | AB222208 | clade__309 | Y | N |
| *Syntrophococcus sucromutans* | 1911 | NR__036869 | clade__309 | Y | N |
| *Rhodobacter* sp. oral taxon C30 | 1620 | HM099648 | clade__310 | N | N |
| *Rhodobacter sphaeroides* | 1621 | CP000144 | clade__310 | N | N |
| *Lactobacillus antri* | 1071 | ACLL01000037 | clade__313 | N | N |
| *Lactobacillus coleohominis* | 1076 | ACOH01000030 | clade__313 | N | N |
| *Lactobacillus fermentum* | 1083 | CP002033 | clade__313 | N | N |
| *Lactobacillus gastricus* | 1085 | AICN01000060 | clade__313 | N | N |
| *Lactobacillus mucosae* | 1099 | FR693800 | clade__313 | N | N |
| *Lactobacillus oris* | 1103 | AEKL01000077 | clade__313 | N | N |
| *Lactobacillus pontis* | 1111 | HM218420 | clade__313 | N | N |
| *Lactobacillus reuteri* | 1112 | ACGW02000012 | clade__313 | N | N |
| *Lactobacillus* sp. KLDS 1.0707 | 1127 | EU600911 | clade__313 | N | N |
| *Lactobacillus* sp. KLDS 1.0709 | 1128 | EU600913 | clade__313 | N | N |
| *Lactobacillus* sp. KLDS 1.0711 | 1129 | EU600915 | clade__313 | N | N |
| *Lactobacillus* sp. KLDS 1.0713 | 1131 | EU600917 | clade__313 | N | N |
| *Lactobacillus* sp. KLDS 1.0716 | 1132 | EU600921 | clade__313 | N | N |
| *Lactobacillus* sp. KLDS 1.0718 | 1133 | EU600922 | clade__313 | N | N |
| *Lactobacillus* sp. oral taxon 052 | 1137 | GQ422710 | clade__313 | N | N |
| *Lactobacillus vaginalis* | 1140 | ACGV01000168 | clade__313 | N | N |
| *Brevibacterium aurantiacum* | 419 | NR__044854 | clade__314 | N | N |
| *Brevibacterium linens* | 423 | AJ315491 | clade__314 | N | N |
| *Lactobacillus pentosus* | 1108 | JN813103 | clade__315 | N | N |
| *Lactobacillus plantarum* | 1110 | ACGZ02000033 | clade__315 | N | N |
| *Lactobacillus* sp. KLDS 1.0702 | 1123 | EU600906 | clade__315 | N | N |
| *Lactobacillus* sp. KLDS 1.0703 | 1124 | EU600907 | clade__315 | N | N |
| *Lactobacillus* sp. KLDS 1.0704 | 1125 | EU600908 | clade__315 | N | N |
| *Lactobacillus* sp. KLDS 1.0705 | 1126 | EU600909 | clade__315 | N | N |
| *Agrobacterium radiobacter* | 115 | CP000628 | clade__316 | N | N |
| *Agrobacterium tumefaciens* | 116 | AJ389893 | clade__316 | N | N |
| *Corynebacterium argentoratense* | 685 | EF463055 | clade__317 | N | N |
| *Corynebacterium diphtheriae* | 693 | NC__002935 | clade__317 | N | OP |
| *Corynebacterium pseudotuberculosis* | 715 | NR__037070 | clade__317 | N | N |
| *Corynebacterium renale* | 717 | NR__037069 | clade__317 | N | N |

TABLE 1-continued

| OTU | SEQ ID Number | Public DB Accession | Phylogenetic Clade | Spore Former | Pathogen Status |
|---|---|---|---|---|---|
| Corynebacterium ulcerans | 731 | NR_074467 | clade_317 | N | N |
| Aurantimonas coralicida | 191 | AY065627 | clade_318 | N | N |
| Aureimonas altamirensis | 192 | FN658986 | clade_318 | N | N |
| Lactobacillus acidipiscis | 1066 | NR_024718 | clade_320 | N | N |
| Lactobacillus salivarius | 1117 | AEBA01000145 | clade_320 | N | N |
| Lactobacillus sp. KLDS 1.0719 | 1134 | EU600923 | clade_320 | N | N |
| Lactobacillus buchneri | 1073 | ACGH01000101 | clade_321 | N | N |
| Lactobacillus genomosp. C1 | 1086 | AY278619 | clade_321 | N | N |
| Lactobacillus genomosp. C2 | 1087 | AY278620 | clade_321 | N | N |
| Lactobacillus hilgardii | 1089 | ACGP01000200 | clade_321 | N | N |
| Lactobacillus kefiri | 1096 | NR_042230 | clade_321 | N | N |
| Lactobacillus parabuchneri | 1105 | NR_041294 | clade_321 | N | N |
| Lactobacillus parakefiri | 1107 | NR_029039 | clade_321 | N | N |
| Lactobacillus curvatus | 1079 | NR_042437 | clade_322 | N | N |
| Lactobacillus sakei | 1116 | DQ989236 | clade_322 | N | N |
| Aneurinibacillus aneurinilyticus | 167 | AB101592 | clade_323 | N | N |
| Aneurinibacillus danicus | 168 | NR_028657 | clade_323 | N | N |
| Aneurinibacillus migulanus | 169 | NR_036799 | clade_323 | N | N |
| Aneurinibacillus terranovensis | 170 | NR_042271 | clade_323 | N | N |
| Staphylococcus aureus | 1757 | CP002643 | clade_325 | N | Category-B |
| Staphylococcus auricularis | 1758 | JQ624774 | clade_325 | N | N |
| Staphylococcus capitis | 1759 | ACFR01000029 | clade_325 | N | N |
| Staphylococcus caprae | 1760 | ACRH01000033 | clade_325 | N | N |
| Staphylococcus carnosus | 1761 | NR_075003 | clade_325 | N | N |
| Staphylococcus cohnii | 1762 | JN175375 | clade_325 | N | N |
| Staphylococcus condimenti | 1763 | NR_029345 | clade_325 | N | N |
| Staphylococcus epidermidis | 1764 | ACHE01000056 | clade_325 | N | N |
| Staphylococcus equorum | 1765 | NR_027520 | clade_325 | N | N |
| Staphylococcus haemolyticus | 1767 | NC_007168 | clade_325 | N | N |
| Staphylococcus hominis | 1768 | AM157418 | clade_325 | N | N |
| Staphylococcus lugdunensis | 1769 | AEQA01000024 | clade_325 | N | N |
| Staphylococcus pasteuri | 1770 | FJ189773 | clade_325 | N | N |
| Staphylococcus pseudintermedius | 1771 | CP002439 | clade_325 | N | N |
| Staphylococcus saccharolyticus | 1772 | NR_029158 | clade_325 | N | N |
| Staphylococcus saprophyticus | 1773 | NC_007350 | clade_325 | N | N |
| Staphylococcus sp. clone bottae7 | 1777 | AF467424 | clade_325 | N | N |
| Staphylococcus sp. H292 | 1775 | AB177642 | clade_325 | N | N |
| Staphylococcus sp. H780 | 1776 | AB177644 | clade_325 | N | N |
| Staphylococcus succinus | 1778 | NR_028667 | clade_325 | N | N |
| Staphylococcus warneri | 1780 | ACPZ01000009 | clade_325 | N | N |
| Staphylococcus xylosus | 1781 | AY395016 | clade_325 | N | N |
| Cardiobacterium hominis | 490 | ACKY01000036 | clade_326 | N | N |
| Cardiobacterium valvarum | 491 | NR_028847 | clade_326 | N | N |
| Pseudomonas fluorescens | 1593 | AY622220 | clade_326 | N | N |
| Pseudomonas gessardii | 1594 | FJ943496 | clade_326 | N | N |
| Pseudomonas monteilii | 1596 | NR_024910 | clade_326 | N | N |
| Pseudomonas poae | 1597 | GU188951 | clade_326 | N | N |
| Pseudomonas putida | 1599 | AF094741 | clade_326 | N | N |
| Pseudomonas sp. G1229 | 1601 | DQ910482 | clade_326 | N | N |
| Pseudomonas tolaasii | 1604 | AF320988 | clade_326 | N | N |
| Pseudomonas viridiflava | 1605 | NR_042764 | clade_326 | N | N |
| Bacillus alcalophilus | 198 | X76436 | clade_327 | Y | N |
| Bacillus clausii | 205 | FN397477 | clade_327 | Y | OP |
| Bacillus gelatini | 210 | NR_025595 | clade_327 | Y | OP |
| Bacillus halodurans | 212 | AY144582 | clade_327 | Y | OP |
| Bacillus sp. oral taxon F26 | 246 | HM099642 | clade_327 | Y | OP |
| Listeria grayi | 1185 | ACCR02000003 | clade_328 | N | OP |
| Listeria innocua | 1186 | JF967625 | clade_328 | N | N |
| Listeria ivanovii | 1187 | X56151 | clade_328 | N | N |
| Listeria monocytogenes | 1188 | CP002003 | clade_328 | N | Category-B |
| Listeria welshimeri | 1189 | AM263198 | clade_328 | N | OP |
| Capnocytophaga sp. oral clone ASCH05 | 484 | AY923149 | clade_333 | N | N |
| Capnocytophaga sputigena | 489 | ABZV01000054 | clade_333 | N | N |
| Leptotrichia genomosp. C1 | 1166 | AY278621 | clade_334 | N | N |
| Leptotrichia shahii | 1169 | AY029806 | clade_334 | N | N |
| Leptotrichia sp. neutropenicPatient | 1170 | AF189244 | clade_334 | N | N |
| Leptotrichia sp. oral clone GT018 | 1171 | AY349384 | clade_334 | N | N |
| Leptotrichia sp. oral clone GT020 | 1172 | AY349385 | clade_334 | N | N |
| Bacteroides sp. 20_3 | 296 | ACRQ01000064 | clade_335 | N | N |
| Bacteroides sp. 3_1_19 | 307 | ADCJ01000062 | clade_335 | N | N |
| Bacteroides sp. 3_2_5 | 311 | ACIB01000079 | clade_335 | N | N |
| Parabacteroides distasonis | 1416 | CP000140 | clade_335 | N | N |
| Parabacteroides goldsteinii | 1417 | AY974070 | clade_335 | N | N |
| Parabacteroides gordonii | 1418 | AB470344 | clade_335 | N | N |
| Parabacteroides sp. D13 | 1421 | ACPW01000017 | clade_335 | N | N |
| Capnocytophaga genomosp. C1 | 477 | AY278613 | clade_336 | N | N |
| Capnocytophaga ochracea | 480 | AEOH01000054 | clade_336 | N | N |

TABLE 1-continued

| OTU | SEQ ID Number | Public DB Accession | Phylogenetic Clade | Spore Former | Pathogen Status |
|---|---|---|---|---|---|
| Capnocytophaga sp. GEJ8 | 481 | GU561335 | clade_336 | N | N |
| Capnocytophaga sp. oral strain A47ROY | 486 | AY005077 | clade_336 | N | N |
| Capnocytophaga sp. S1b | 482 | U42009 | clade_336 | N | N |
| Paraprevotella clara | 1426 | AFFY01000068 | clade_336 | N | N |
| Bacteroides heparinolyticus | 282 | JN867284 | clade_338 | N | N |
| Prevotella heparinolytica | 1500 | GQ422742 | clade_338 | N | N |
| Treponema genomosp. P4 oral clone MB2_G19 | 1928 | DQ003618 | clade_339 | N | N |
| Treponema genomosp. P6 oral clone MB4_G11 | 1930 | DQ003625 | clade_339 | N | N |
| Treponema sp. oral taxon 254 | 1952 | GU408803 | clade_339 | N | N |
| Treponema sp. oral taxon 508 | 1956 | GU413616 | clade_339 | N | N |
| Treponema sp. oral taxon 518 | 1957 | GU413640 | clade_339 | N | N |
| Chlamydia muridarum | 502 | AE002160 | clade_341 | N | OP |
| Chlamydia trachomatis | 504 | U68443 | clade_341 | N | OP |
| Chlamydia psittaci | 503 | NR_036864 | clade_342 | N | Category-B |
| Chlamydophila pneumoniae | 509 | NC_002179 | clade_342 | N | OP |
| Chlamydophila psittaci | 510 | D85712 | clade_342 | N | OP |
| Anaerococcus octavius | 146 | NR_026360 | clade_343 | N | N |
| Anaerococcus sp. 8405254 | 149 | HM587319 | clade_343 | N | N |
| Anaerococcus sp. 9401487 | 150 | HM587322 | clade_343 | N | N |
| Anaerococcus sp. 9403502 | 151 | HM587325 | clade_343 | N | N |
| Gardnerella vaginalis | 923 | CP001849 | clade_344 | N | N |
| Campylobacter lari | 466 | CP000932 | clade_346 | N | OP |
| Anaerobiospirillum succiniciproducens | 142 | NR_026075 | clade_347 | N | N |
| Anaerobiospirillum thomasii | 143 | AJ420985 | clade_347 | N | N |
| Ruminobacter amylophilus | 1654 | NR_026450 | clade_347 | N | N |
| Succinatimonas hippei | 1897 | AEVO01000027 | clade_347 | N | N |
| Actinomyces europaeus | 54 | NR_026363 | clade_348 | N | N |
| Actinomyces sp. oral clone GU009 | 82 | AY349361 | clade_348 | N | N |
| Moraxella catarrhalis | 1260 | CP002005 | clade_349 | N | N |
| Moraxella lincolnii | 1261 | FR822735 | clade_349 | N | N |
| Moraxella sp. 16285 | 1263 | JF682466 | clade_349 | N | N |
| Psychrobacter sp. 13983 | 1613 | HM212668 | clade_349 | N | N |
| Actinobaculum massiliae | 49 | AF487679 | clade_350 | N | N |
| Actinobaculum schaalii | 50 | AY957507 | clade_350 | N | N |
| Actinobaculum sp. BM#101342 | 51 | AY282578 | clade_350 | N | N |
| Actinobaculum sp. P2P_19 P1 | 52 | AY207066 | clade_350 | N | N |
| Actinomyces sp. oral clone IO076 | 84 | AY349363 | clade_350 | N | N |
| Actinomyces sp. oral taxon 848 | 93 | ACUY01000072 | clade_350 | N | N |
| Clostridium innocuum | 595 | M23732 | clade_351 | Y | N |
| Clostridium sp. HGF2 | 628 | AENW01000022 | clade_351 | Y | N |
| Actinomyces neuii | 65 | X71862 | clade_352 | N | N |
| Mobiluncus mulieris | 1252 | ACKW01000035 | clade_352 | N | N |
| Clostridium perfringens | 612 | ABDW01000023 | clade_353 | Y | Category-B |
| Sarcina ventriculi | 1687 | NR_026146 | clade_353 | Y | N |
| Clostridium bartlettii | 556 | ABEZ02000012 | clade_354 | Y | N |
| Clostridium bifermentans | 558 | X73437 | clade_354 | Y | N |
| Clostridium ghonii | 586 | AB542933 | clade_354 | Y | N |
| Clostridium glycolicum | 587 | FJ384385 | clade_354 | Y | N |
| Clostridium mayombei | 605 | FR733682 | clade_354 | Y | N |
| Clostridium sordellii | 625 | AB448946 | clade_354 | Y | N |
| Clostridium sp. MT4 E | 635 | FJ159523 | clade_354 | Y | N |
| Eubacterium tenue | 872 | M59118 | clade_354 | Y | N |
| Clostridium argentinense | 553 | NR_029232 | clade_355 | Y | N |
| Clostridium sp. JC122 | 630 | CAEV01000127 | clade_355 | Y | N |
| Clostridium sp. NMBHI_1 | 636 | JN093130 | clade_355 | Y | N |
| Clostridium subterminale | 650 | NR_041795 | clade_355 | Y | N |
| Clostridium sulfidigenes | 651 | NR_044161 | clade_355 | Y | N |
| Blastomonas natatoria | 372 | NR_040824 | clade_356 | N | N |
| Novosphingobium aromaticivorans | 1357 | AAAV03000008 | clade_356 | N | N |
| Sphingomonas sp. oral clone FI012 | 1745 | AY349411 | clade_356 | N | N |
| Sphingopyxis alaskensis | 1749 | CP000356 | clade_356 | N | N |
| Oxalobacter formigenes | 1389 | ACDQ01000020 | clade_357 | N | N |
| Veillonella atypica | 1974 | AEDS01000059 | clade_358 | N | N |
| Veillonella dispar | 1975 | ACIK02000021 | clade_358 | N | N |
| Veillonella genomosp. P1 oral clone MB5_P17 | 1976 | DQ003631 | clade_358 | N | N |
| Veillonella parvula | 1978 | ADFU01000009 | clade_358 | N | N |
| Veillonella sp. 3_1_44 | 1979 | ADCV01000019 | clade_358 | N | N |
| Veillonella sp. 6_1_27 | 1980 | ADCW01000016 | clade_358 | N | N |
| Veillonella sp. ACP1 | 1981 | HQ616359 | clade_358 | N | N |
| Veillonella sp. AS16 | 1982 | HQ616365 | clade_358 | N | N |
| Veillonella sp. BS32b | 1983 | HQ616368 | clade_358 | N | N |
| Veillonella sp. ICM51a | 1984 | HQ616396 | clade_358 | N | N |
| Veillonella sp. MSA12 | 1985 | HQ616381 | clade_358 | N | N |
| Veillonella sp. NVG 100cf | 1986 | EF108443 | clade_358 | N | N |

TABLE 1-continued

| OTU | SEQ ID Number | Public DB Accession | Phylogenetic Clade | Spore Former | Pathogen Status |
|---|---|---|---|---|---|
| *Veillonella* sp. OK11 | 1987 | JN695650 | clade_358 | N | N |
| *Veillonella* sp. oral clone ASCG01 | 1990 | AY923144 | clade_358 | N | N |
| *Veillonella* sp. oral clone ASCG02 | 1991 | AY953257 | clade_358 | N | N |
| *Veillonella* sp. oral clone OH1A | 1992 | AY947495 | clade_358 | N | N |
| *Veillonella* sp. oral taxon 158 | 1993 | AENU01000007 | clade_358 | N | N |
| *Dorea formicigenerans* | 773 | AAXA02000006 | clade_360 | Y | N |
| *Dorea longicatena* | 774 | AJ132842 | clade_360 | Y | N |
| Lachnospiraceae bacterium 2_1_46FAA | 1050 | ADLB01000035 | clade_360 | Y | N |
| Lachnospiraceae bacterium 2_1_58FAA | 1051 | ACTO01000052 | clade_360 | Y | N |
| Lachnospiraceae bacterium 4_1_37FAA | 1053 | ADCR01000030 | clade_360 | Y | N |
| Lachnospiraceae bacterium 9_1_43BFAA | 1058 | ACTX01000023 | clade_360 | Y | N |
| *Ruminococcus gnavus* | 1661 | X94967 | clade_360 | Y | N |
| *Ruminococcus* sp. ID8 | 1668 | AY960564 | clade_360 | Y | N |
| *Kocuria marina* | 1040 | GQ260086 | clade_365 | N | N |
| *Kocuria rhizophila* | 1042 | AY030315 | clade_365 | N | N |
| *Kocuria rosea* | 1043 | X87756 | clade_365 | N | N |
| *Kocuria varians* | 1044 | AF542074 | clade_365 | N | N |
| *Blautia hydrogenotrophica* | 377 | ACBZ01000217 | clade_368 | Y | N |
| *Clostridiaceae bacterium END_2* | 531 | EF451053 | clade_368 | N | N |
| *Lactonifactor longoviformis* | 1147 | DQ100449 | clade_368 | Y | N |
| *Robinsoniella peoriensis* | 1633 | AF445258 | clade_368 | Y | N |
| *Micrococcus antarcticus* | 1242 | NR_025285 | clade_371 | N | N |
| *Micrococcus luteus* | 1243 | NR_075062 | clade_371 | N | N |
| *Micrococcus lylae* | 1244 | NR_026200 | clade_371 | N | N |
| *Micrococcus* sp. 185 | 1245 | EU714334 | clade_371 | N | N |
| *Lactobacillus brevis* | 1072 | EU194349 | clade_372 | N | N |
| *Lactobacillus parabrevis* | 1104 | NR_042456 | clade_372 | N | N |
| *Pediococcus acidilactici* | 1436 | ACXB01000026 | clade_372 | N | N |
| *Pediococcus pentosaceus* | 1437 | NR_075052 | clade_372 | N | N |
| *Lactobacillus dextrinicus* | 1081 | NR_036861 | clade_373 | N | N |
| *Lactobacillus perolens* | 1109 | NR_029360 | clade_373 | N | N |
| *Lactobacillus rhamnosus* | 1113 | ABWJ01000068 | clade_373 | N | N |
| *Lactobacillus saniviri* | 1118 | AB602569 | clade_373 | N | N |
| *Lactobacillus* sp. BT6 | 1121 | HQ616370 | clade_373 | N | N |
| *Mycobacterium mageritense* | 1282 | FR798914 | clade_374 | N | OP |
| *Mycobacterium neoaurum* | 1286 | AF268445 | clade_374 | N | OP |
| *Mycobacterium smegmatis* | 1291 | CP000480 | clade_374 | N | OP |
| *Mycobacterium* sp. HE5 | 1304 | AJ012738 | clade_374 | N | N |
| *Dysgonomonas gadei* | 775 | ADLV01000001 | clade_377 | N | N |
| *Dysgonomonas mossii* | 776 | ADLW01000023 | clade_377 | N | N |
| *Porphyromonas levii* | 1474 | NR_025907 | clade_377 | N | N |
| *Porphyromonas somerae* | 1476 | AB547667 | clade_377 | N | N |
| *Bacteroides barnesiae* | 267 | NR_041446 | clade_378 | N | N |
| *Bacteroides coprocola* | 272 | ABIY02000050 | clade_378 | N | N |
| *Bacteroides coprophilus* | 273 | ACBW01000012 | clade_378 | N | N |
| *Bacteroides dorei* | 274 | ABWZ01000093 | clade_378 | N | N |
| *Bacteroides massiliensis* | 284 | AB200226 | clade_378 | N | N |
| *Bacteroides plebeius* | 289 | AB200218 | clade_378 | N | N |
| *Bacteroides* sp. 3_1_33FAA | 309 | ACPS01000085 | clade_378 | N | N |
| *Bacteroides* sp. 3_1_40A | 310 | ACRT01000136 | clade_378 | N | N |
| *Bacteroides* sp. 4_3_47FAA | 313 | ACDR02000029 | clade_378 | N | N |
| *Bacteroides* sp. 9_1_42FAA | 314 | ACAA01000096 | clade_378 | N | N |
| *Bacteroides* sp. NB_8 | 323 | AB117565 | clade_378 | N | N |
| *Bacteroides vulgatus* | 331 | CP000139 | clade_378 | N | N |
| *Bacteroides ovatus* | 287 | ACWH01000036 | clade_38 | N | N |
| *Bacteroides* sp. 1_1_30 | 294 | ADCL01000128 | clade_38 | N | N |
| *Bacteroides* sp. 2_1_22 | 297 | ACPQ01000117 | clade_38 | N | N |
| *Bacteroides* sp. 2_2_4 | 299 | ABZZ01000168 | clade_38 | N | N |
| *Bacteroides* sp. 3_1_23 | 308 | ACRS01000081 | clade_38 | N | N |
| *Bacteroides* sp. D1 | 318 | ACAB02000030 | clade_38 | N | N |
| *Bacteroides* sp. D2 | 321 | ACGA01000077 | clade_38 | N | N |
| *Bacteroides* sp. D22 | 320 | ADCK01000151 | clade_38 | N | N |
| *Bacteroides xylanisolvens* | 332 | ADKP01000087 | clade_38 | N | N |
| *Treponema lecithinolyticum* | 1931 | NR_026247 | clade_380 | N | OP |
| *Treponema parvum* | 1933 | AF302937 | clade_380 | N | OP |
| *Treponema* sp. oral clone JU025 | 1940 | AY349417 | clade_380 | N | N |
| *Treponema* sp. oral taxon 270 | 1954 | GQ422733 | clade_380 | N | N |
| *Parascardovia denticolens* | 1428 | ADEB01000020 | clade_381 | N | N |
| *Scardovia inopinata* | 1688 | AB029087 | clade_381 | N | N |
| *Scardovia wiggsiae* | 1689 | AY278626 | clade_381 | N | N |
| Clostridiales bacterium 9400853 | 533 | HM587320 | clade_384 | N | N |
| *Eubacterium infirmum* | 849 | U13039 | clade_384 | Y | N |
| *Eubacterium* sp. WAL 14571 | 864 | FJ687606 | clade_384 | Y | N |
| *Mogibacterium diversum* | 1254 | NR_027191 | clade_384 | N | N |
| *Mogibacterium neglectum* | 1255 | NR_027203 | clade_384 | N | N |
| *Mogibacterium pumilum* | 1256 | NR_028608 | clade_384 | N | N |
| *Mogibacterium timidum* | 1257 | Z36296 | clade_384 | N | N |

TABLE 1-continued

| OTU | SEQ ID Number | Public DB Accession | Phylogenetic Clade | Spore Former | Pathogen Status |
|---|---|---|---|---|---|
| Erysipelotrichaceae bacterium 5_2_54FAA | 823 | ACZW01000054 | clade_385 | Y | N |
| Eubacterium biforme | 835 | ABYT01000002 | clade_385 | Y | N |
| Eubacterium cylindroides | 842 | FP929041 | clade_385 | Y | N |
| Eubacterium dolichum | 844 | L34682 | clade_385 | Y | N |
| Eubacterium sp. 3_1_31 | 861 | ACTL01000045 | clade_385 | Y | N |
| Eubacterium tortuosum | 873 | NR_044648 | clade_385 | Y | N |
| Borrelia burgdorferi | 389 | ABGI01000001 | clade_386 | N | OP |
| Borrelia garinii | 392 | ABJV01000001 | clade_386 | N | OP |
| Borrelia sp. NE49 | 397 | AJ224142 | clade_386 | N | OP |
| Caldimonas manganoxidans | 457 | NR_040787 | clade_387 | N | N |
| Comamonadaceae bacterium oral taxon F47 | 667 | HM099651 | clade_387 | N | N |
| Lautropia mirabilis | 1149 | AEQP01000026 | clade_387 | N | N |
| Lautropia sp. oral clone AP009 | 1150 | AY005030 | clade_387 | N | N |
| Bulleidia extructa | 441 | ADFR01000011 | clade_388 | Y | N |
| Solobacterium moorei | 1739 | AECQ01000039 | clade_388 | Y | N |
| Peptoniphilus asaccharolyticus | 1441 | D14145 | clade_389 | N | N |
| Peptoniphilus duerdenii | 1442 | EU526290 | clade_389 | N | N |
| Peptoniphilus harei | 1443 | NR_026358 | clade_389 | N | N |
| Peptoniphilus indolicus | 1444 | AY153431 | clade_389 | N | N |
| Peptoniphilus lacrimalis | 1446 | ADDO01000050 | clade_389 | N | N |
| Peptoniphilus sp. gpac077 | 1450 | AM176527 | clade_389 | N | N |
| Peptoniphilus sp. JC140 | 1447 | JF824803 | clade_389 | N | N |
| Peptoniphilus sp. oral taxon 386 | 1452 | ADCS01000031 | clade_389 | N | N |
| Peptoniphilus sp. oral taxon 836 | 1453 | AEAA01000090 | clade_389 | N | N |
| Peptostreptococcaceae bacterium ph1 | 1454 | JN837495 | clade_389 | N | N |
| Dialister pneumosintes | 765 | HM596297 | clade_390 | N | N |
| Dialister sp. oral taxon 502 | 767 | GQ422739 | clade_390 | N | N |
| Cupriavidus metallidurans | 741 | GU230889 | clade_391 | N | N |
| Herbaspirillum seropedicae | 1001 | CP002039 | clade_391 | N | N |
| Herbaspirillum sp. JC206 | 1002 | JN657219 | clade_391 | N | N |
| Janthinobacterium sp. SY12 | 1015 | EF455530 | clade_391 | N | N |
| Massilia sp. CCUG 43427A | 1197 | FR773700 | clade_391 | N | N |
| Ralstonia pickettii | 1615 | NC_010682 | clade_391 | N | N |
| Ralstonia sp. 5_7_47FAA | 1616 | ACUF01000076 | clade_391 | N | N |
| Francisella novicida | 889 | ABSS01000002 | clade_392 | N | N |
| Francisella philomiragia | 890 | AY928394 | clade_392 | N | N |
| Francisella tularensis | 891 | ABAZ01000082 | clade_392 | N | Category-A |
| Ignatzschineria indica | 1009 | HQ823562 | clade_392 | N | N |
| Ignatzschineria sp. NML 95_0260 | 1010 | HQ823559 | clade_392 | N | N |
| Coprococcus catus | 673 | EU266552 | clade_393 | Y | N |
| Lachnospiraceae bacterium oral taxon F15 | 1064 | HM099641 | clade_393 | Y | N |
| Streptococcus mutans | 1814 | AP010655 | clade_394 | N | N |
| Clostridium cochlearium | 574 | NR_044717 | clade_395 | Y | N |
| Clostridium malenominatum | 604 | FR749893 | clade_395 | Y | N |
| Clostridium tetani | 654 | NC_004557 | clade_395 | Y | N |
| Acetivibrio ethanolgignens | 6 | FR749897 | clade_396 | Y | N |
| Anaerosporobacter mobilis | 161 | NR_042953 | clade_396 | Y | N |
| Bacteroides pectinophilus | 288 | ABVQ01000036 | clade_396 | Y | N |
| Clostridium aminovalericum | 551 | NR_029245 | clade_396 | Y | N |
| Clostridium phytofermentans | 613 | NR_074652 | clade_396 | Y | N |
| Eubacterium hallii | 848 | L34621 | clade_396 | Y | N |
| Eubacterium xylanophilum | 875 | L34628 | clade_396 | Y | N |
| Lactobacillus gasseri | 1084 | ACOZ01000018 | clade_398 | N | N |
| Lactobacillus hominis | 1090 | FR681902 | clade_398 | N | N |
| Lactobacillus iners | 1091 | AEKJ01000002 | clade_398 | N | N |
| Lactobacillus johnsonii | 1093 | AE017198 | clade_398 | N | N |
| Lactobacillus senioris | 1119 | AB602570 | clade_398 | N | N |
| Lactobacillus sp. oral clone HT002 | 1135 | AY349382 | clade_398 | N | N |
| Weissella beninensis | 2006 | EU439435 | clade_398 | N | N |
| Sphingomonas echinoides | 1744 | NR_024700 | clade_399 | N | N |
| Sphingomonas sp. oral taxon A09 | 1747 | HM099639 | clade_399 | N | N |
| Sphingomonas sp. oral taxon F71 | 1748 | HM099645 | clade_399 | N | N |
| Zymomonas mobilis | 2032 | NR_074274 | clade_399 | N | N |
| Arcanobacterium haemolyticum | 174 | NR_025347 | clade_400 | N | N |
| Arcanobacterium pyogenes | 175 | GU585578 | clade_400 | N | N |
| Trueperella pyogenes | 1962 | NR_044858 | clade_400 | N | N |
| Lactococcus garvieae | 1144 | AF061005 | clade_401 | N | N |
| Lactococcus lactis | 1145 | CP002365 | clade_401 | N | N |
| Brevibacterium mcbrellneri | 424 | ADNU01000076 | clade_402 | N | N |
| Brevibacterium paucivorans | 425 | EU086796 | clade_402 | N | N |
| Brevibacterium sp. JC43 | 428 | JF824806 | clade_402 | N | N |
| Selenomonas artemidis | 1692 | HM596274 | clade_403 | N | N |
| Selenomonas sp. FOBRC9 | 1704 | HQ616378 | clade_403 | N | N |
| Selenomonas sp. oral taxon 137 | 1715 | AENV01000007 | clade_403 | N | N |
| Desmospora activa | 751 | AM940019 | clade_404 | N | N |
| Desmospora sp. 8437 | 752 | AFHT01000143 | clade_404 | N | N |

TABLE 1-continued

| OTU | SEQ ID Number | Public DB Accession | Phylogenetic Clade | Spore Former | Pathogen Status |
|---|---|---|---|---|---|
| *Paenibacillus* sp. oral taxon F45 | 1407 | HM099647 | clade_404 | N | N |
| *Corynebacterium ammoniagenes* | 682 | ADNS01000011 | clade_405 | N | N |
| *Corynebacterium aurimucosum* | 687 | ACLH01000041 | clade_405 | N | N |
| *Corynebacterium bovis* | 688 | AF537590 | clade_405 | N | N |
| *Corynebacterium canis* | 689 | GQ871934 | clade_405 | N | N |
| *Corynebacterium casei* | 690 | NR_025101 | clade_405 | N | N |
| *Corynebacterium durum* | 694 | Z97069 | clade_405 | N | N |
| *Corynebacterium efficiens* | 695 | ACLI01000121 | clade_405 | N | N |
| *Corynebacterium falsenii* | 696 | Y13024 | clade_405 | N | N |
| *Corynebacterium flavescens* | 697 | NR_037040 | clade_405 | N | N |
| *Corynebacterium glutamicum* | 701 | BA000036 | clade_405 | N | N |
| *Corynebacterium jeikeium* | 704 | ACYW01000001 | clade_405 | N | OP |
| *Corynebacterium kroppenstedtii* | 705 | NR_026380 | clade_405 | N | N |
| *Corynebacterium lipophiloflavum* | 706 | ACHJ01000075 | clade_405 | N | N |
| *Corynebacterium matruchotii* | 709 | ACSH02000003 | clade_405 | N | N |
| *Corynebacterium minutissimum* | 710 | X82064 | clade_405 | N | N |
| *Corynebacterium resistens* | 718 | ADGN01000058 | clade_405 | N | N |
| *Corynebacterium simulans* | 720 | AF537604 | clade_405 | N | N |
| *Corynebacterium singulare* | 721 | NR_026394 | clade_405 | N | N |
| *Corynebacterium* sp. 1 ex sheep | 722 | Y13427 | clade_405 | N | N |
| *Corynebacterium* sp. NML 99_0018 | 726 | GU238413 | clade_405 | N | N |
| *Corynebacterium striatum* | 727 | ACGE01000001 | clade_405 | N | OP |
| *Corynebacterium urealyticum* | 732 | X81913 | clade_405 | N | OP |
| *Corynebacterium variabile* | 734 | NR_025314 | clade_405 | N | N |
| *Ruminococcus callidus* | 1658 | NR_029160 | clade_406 | Y | N |
| *Ruminococcus champanellensis* | 1659 | FP929052 | clade_406 | Y | N |
| *Ruminococcus* sp. 18P13 | 1665 | AJ515913 | clade_406 | Y | N |
| *Ruminococcus* sp. 9SE51 | 1667 | FM954974 | clade_406 | Y | N |
| *Aerococcus sanguinicola* | 98 | AY837833 | clade_407 | N | N |
| *Aerococcus urinae* | 99 | CP002512 | clade_407 | N | N |
| *Aerococcus urinaeequi* | 100 | NR_043443 | clade_407 | N | N |
| *Aerococcus viridans* | 101 | ADNT01000041 | clade_407 | N | N |
| *Anaerostipes caccae* | 162 | ABAX03000023 | clade_408 | Y | N |
| *Anaerostipes* sp. 3_2_56FAA | 163 | ACWB01000002 | clade_408 | Y | N |
| Clostridiales bacterium 1_7_47FAA | 541 | ABQR01000074 | clade_408 | Y | N |
| Clostridiales sp. SM4_1 | 542 | FP929060 | clade_408 | Y | N |
| Clostridiales sp. SSC_2 | 544 | FP929061 | clade_408 | Y | N |
| *Clostridium aerotolerans* | 546 | X76163 | clade_408 | Y | N |
| *Clostridium aldenense* | 547 | NR_043680 | clade_408 | Y | N |
| *Clostridium algidixylanolyticum* | 550 | NR_028726 | clade_408 | Y | N |
| *Clostridium amygdalinum* | 552 | AY353957 | clade_408 | Y | N |
| *Clostridium asparagiforme* | 554 | ACCJ01000522 | clade_408 | Y | N |
| *Clostridium bolteae* | 559 | ABCC02000039 | clade_408 | Y | N |
| *Clostridium celerecrescens* | 566 | JQ246092 | clade_408 | Y | N |
| *Clostridium citroniae* | 569 | ADLJ01000059 | clade_408 | Y | N |
| *Clostridium clostridiiformes* | 571 | M59089 | clade_408 | Y | N |
| *Clostridium clostridioforme* | 572 | NR_044715 | clade_408 | Y | N |
| *Clostridium hathewayi* | 590 | AY552788 | clade_408 | Y | N |
| *Clostridium indolis* | 594 | AF028351 | clade_408 | Y | N |
| *Clostridium lavalense* | 600 | EF564277 | clade_408 | Y | N |
| *Clostridium saccharolyticum* | 620 | CP002109 | clade_408 | Y | N |
| *Clostridium* sp. M62_1 | 633 | ACFX02000046 | clade_408 | Y | N |
| *Clostridium* sp. SS2_1 | 638 | ABGC03000041 | clade_408 | Y | N |
| *Clostridium sphenoides* | 643 | X73449 | clade_408 | Y | N |
| *Clostridium symbiosum* | 652 | ADLQ01000114 | clade_408 | Y | N |
| *Clostridium xylanolyticum* | 658 | NR_037068 | clade_408 | Y | N |
| *Eubacterium hadrum* | 847 | FR749933 | clade_408 | Y | N |
| *Fusobacterium naviforme* | 898 | HQ223106 | clade_408 | N | N |
| Lachnospiraceae bacterium 3_1_57FAA | 1052 | ACTP01000124 | clade_408 | Y | N |
| Lachnospiraceae bacterium 5_1_63FAA | 1055 | ACTS01000081 | clade_408 | Y | N |
| Lachnospiraceae bacterium A4 | 1059 | DQ789118 | clade_408 | Y | N |
| Lachnospiraceae bacterium DJF VP30 | 1060 | EU728771 | clade_408 | Y | N |
| Lachnospiraceae genomosp. C1 | 1065 | AY278618 | clade_408 | Y | N |
| *Moryella indoligenes* | 1268 | AF527773 | clade_408 | N | N |
| *Clostridium difficile* | 578 | NC_013315 | clade_409 | Y | OP |
| *Selenomonas* genomosp. P5 | 1697 | AY341820 | clade_410 | N | N |
| *Selenomonas* sp. oral clone IQ048 | 1710 | AY349408 | clade_410 | N | N |
| *Selenomonas sputigena* | 1717 | ACKP02000033 | clade_410 | N | N |
| *Hyphomicrobium sulfonivorans* | 1007 | AY468372 | clade_411 | N | N |
| *Methylocella silvestris* | 1228 | NR_074237 | clade_411 | N | N |
| *Legionella pneumophila* | 1153 | NC_002942 | clade_412 | N | OP |
| *Lactobacillus coryniformis* | 1077 | NR_044705 | clade_413 | N | N |
| *Arthrobacter agilis* | 178 | NR_026198 | clade_414 | N | N |
| *Arthrobacter arilaitensis* | 179 | NR_074608 | clade_414 | N | N |
| *Arthrobacter bergerei* | 180 | NR_025612 | clade_414 | N | N |
| *Arthrobacter globiformis* | 181 | NR_026187 | clade_414 | N | N |
| *Arthrobacter nicotianae* | 182 | NR_026190 | clade_414 | N | N |

TABLE 1-continued

| OTU | SEQ ID Number | Public DB Accession | Phylogenetic Clade | Spore Former | Pathogen Status |
|---|---|---|---|---|---|
| *Mycobacterium abscessus* | 1269 | AGQU01000002 | clade_418 | N | OP |
| *Mycobacterium chelonae* | 1273 | AB548610 | clade_418 | N | OP |
| *Bacteroides salanitronis* | 291 | CP002530 | clade_419 | N | N |
| *Paraprevotella xylaniphila* | 1427 | AFBR01000011 | clade_419 | N | N |
| *Barnesiella intestinihominis* | 336 | AB370251 | clade_420 | N | N |
| *Barnesiella viscericola* | 337 | NR_041508 | clade_420 | N | N |
| *Parabacteroides* sp. NS31_3 | 1422 | JN029805 | clade_420 | N | N |
| Porphyromonadaceae bacterium NML 060648 | 1470 | EF184292 | clade_420 | N | N |
| *Tannerella forsythia* | 1913 | CP003191 | clade_420 | N | N |
| *Tannerella* sp. 6_1_58FAA_CT1 | 1914 | ACWX01000068 | clade_420 | N | N |
| *Mycoplasma amphoriforme* | 1311 | AY531656 | clade_421 | N | N |
| *Mycoplasma genitalium* | 1317 | L43967 | clade_421 | N | N |
| *Mycoplasma pneumoniae* | 1322 | NC_000912 | clade_421 | N | N |
| *Mycoplasma penetrans* | 1321 | NC_004432 | clade_422 | N | N |
| *Ureaplasma parvum* | 1966 | AE002127 | clade_422 | N | N |
| *Ureaplasma urealyticum* | 1967 | AAYN01000002 | clade_422 | N | N |
| *Treponema* genomosp. P1 | 1927 | AY341822 | clade_425 | N | N |
| *Treponema* sp. oral taxon 228 | 1943 | GU408580 | clade_425 | N | N |
| *Treponema* sp. oral taxon 230 | 1944 | GU408603 | clade_425 | N | N |
| *Treponema* sp. oral taxon 231 | 1945 | GU408631 | clade_425 | N | N |
| *Treponema* sp. oral taxon 232 | 1946 | GU408646 | clade_425 | N | N |
| *Treponema* sp. oral taxon 235 | 1947 | GU408673 | clade_425 | N | N |
| *Treponema* sp. ovine footrot | 1959 | AJ010951 | clade_425 | N | N |
| *Treponema vincentii* | 1960 | ACYH01000036 | clade_425 | N | OP |
| *Eubacterium* sp. AS15b | 862 | HQ616364 | clade_428 | Y | N |
| *Eubacterium* sp. OBRC9 | 863 | HQ616354 | clade_428 | Y | N |
| *Eubacterium* sp. oral clone OH3A | 871 | AY947497 | clade_428 | Y | N |
| *Eubacterium yurii* | 876 | AEES01000073 | clade_428 | Y | N |
| *Clostridium acetobutylicum* | 545 | NR_074511 | clade_430 | Y | N |
| *Clostridium algidicarnis* | 549 | NR_041746 | clade_430 | Y | N |
| *Clostridium cadaveris* | 562 | AB542932 | clade_430 | Y | N |
| *Clostridium carboxidivorans* | 563 | FR733710 | clade_430 | Y | N |
| *Clostridium estertheticum* | 580 | NR_042153 | clade_430 | Y | N |
| *Clostridium fallax* | 581 | NR_044714 | clade_430 | Y | N |
| *Clostridium felsineum* | 583 | AF270502 | clade_430 | Y | N |
| *Clostridium frigidicarnis* | 584 | NR_024919 | clade_430 | Y | N |
| *Clostridium kluyveri* | 598 | NR_074165 | clade_430 | Y | N |
| *Clostridium magnum* | 603 | X77835 | clade_430 | Y | N |
| *Clostridium putrefaciens* | 615 | NR_024995 | clade_430 | Y | N |
| *Clostridium* sp. HPB_46 | 629 | AY862516 | clade_430 | Y | N |
| *Clostridium tyrobutyricum* | 656 | NR_044718 | clade_430 | Y | N |
| *Burkholderiales bacterium* 1_1_47 | 452 | ADCQ01000066 | clade_432 | N | OP |
| *Parasutterella excrementihominis* | 1429 | AFBP01000029 | clade_432 | N | N |
| *Parasutterella secunda* | 1430 | AB491209 | clade_432 | N | N |
| *Sutterella morbirens* | 1898 | AJ832129 | clade_432 | N | N |
| *Sutterella parvirubra* | 1899 | AB300989 | clade_432 | Y | N |
| *Sutterella sanguinus* | 1900 | AJ748647 | clade_432 | N | N |
| *Sutterella* sp. YIT 12072 | 1901 | AB491210 | clade_432 | N | N |
| *Sutterella stercoricanis* | 1902 | NR_025600 | clade_432 | N | N |
| *Sutterella wadsworthensis* | 1903 | ADMF01000048 | clade_432 | N | N |
| *Propionibacterium freudenreichii* | 1572 | NR_036972 | clade_433 | N | N |
| *Propionibacterium* sp. oral taxon 192 | 1580 | GQ422728 | clade_433 | N | N |
| *Tessaracoccus* sp. oral taxon F04 | 1917 | HM099640 | clade_433 | N | N |
| *Peptoniphilus ivorii* | 1445 | Y07840 | clade_434 | N | N |
| *Peptoniphilus* sp. gpac007 | 1448 | AM176517 | clade_434 | N | N |
| *Peptoniphilus* sp. gpac018A | 1449 | AM176519 | clade_434 | N | N |
| *Peptoniphilus* sp. gpac148 | 1451 | AM176535 | clade_434 | N | N |
| *Flexispira rappini* | 887 | AY126479 | clade_436 | N | N |
| *Helicobacter bilis* | 993 | ACDN01000023 | clade_436 | N | N |
| *Helicobacter cinaedi* | 995 | ABQT01000054 | clade_436 | N | N |
| *Helicobacter* sp. None | 998 | U44756 | clade_436 | N | N |
| *Brevundimonas subvibrioides* | 429 | CP002102 | clade_438 | N | N |
| *Hyphomonas neptunium* | 1008 | NR_074092 | clade_438 | N | N |
| *Phenylobacterium zucineum* | 1465 | AY628697 | clade_438 | N | N |
| *Acetanaerobacterium elongatum* | 4 | NR_042930 | clade_439 | Y | N |
| *Clostridium cellulosi* | 567 | NR_044624 | clade_439 | Y | N |
| *Ethanoligenens harbinense* | 832 | AY675965 | clade_439 | Y | N |
| *Streptococcus downei* | 1793 | AEKN01000002 | clade_441 | N | N |
| *Streptococcus* sp. SHV515 | 1848 | Y07601 | clade_441 | N | N |
| *Acinetobacter* sp. CIP 53.82 | 40 | JQ638584 | clade_443 | N | N |
| *Halomonas elongata* | 990 | NR_074782 | clade_443 | N | N |
| *Halomonas johnsoniae* | 991 | FR775979 | clade_443 | N | N |
| *Butyrivibrio fibrisolvens* | 456 | U41172 | clade_444 | N | N |
| *Eubacterium rectale* | 856 | FP929042 | clade_444 | Y | N |
| *Eubacterium* sp. oral clone GI038 | 865 | AY349374 | clade_444 | Y | N |
| *Lachnobacterium bovis* | 1045 | GU324407 | clade_444 | Y | N |

TABLE 1-continued

| OTU | SEQ ID Number | Public DB Accession | Phylogenetic Clade | Spore Former | Pathogen Status |
|---|---|---|---|---|---|
| Roseburia cecicola | 1634 | GU233441 | clade_444 | Y | N |
| Roseburia faecalis | 1635 | AY804149 | clade_444 | Y | N |
| Roseburia faecis | 1636 | AY305310 | clade_444 | Y | N |
| Roseburia hominis | 1637 | AJ270482 | clade_444 | Y | N |
| Roseburia intestinalis | 1638 | FP929050 | clade_444 | Y | N |
| Roseburia inulinivorans | 1639 | AJ270473 | clade_444 | Y | N |
| Roseburia sp. 11SE37 | 1640 | FM954975 | clade_444 | N | N |
| Roseburia sp. 11SE38 | 1641 | FM954976 | clade_444 | N | N |
| Shuttleworthia satelles | 1728 | ACIP02000004 | clade_444 | N | N |
| Shuttleworthia sp. MSX8B | 1729 | HQ616383 | clade_444 | N | N |
| Shuttleworthia sp. oral taxon G69 | 1730 | GU432167 | clade_444 | N | N |
| Bdellovibrio sp. MPA | 344 | AY294215 | clade_445 | N | N |
| Desulfobulbus sp. oral clone CH031 | 755 | AY005036 | clade_445 | N | N |
| Desulfovibrio desulfuricans | 757 | DQ092636 | clade_445 | N | N |
| Desulfovibrio fairfieldensis | 758 | U42221 | clade_445 | N | N |
| Desulfovibrio piger | 759 | AF192152 | clade_445 | N | N |
| Desulfovibrio sp. 3_1_syn3 | 760 | ADDR01000239 | clade_445 | N | N |
| Geobacter bemidjiensis | 941 | CP001124 | clade_445 | N | N |
| Brachybacterium alimentarium | 401 | NR_026269 | clade_446 | N | N |
| Brachybacterium conglomeratum | 402 | AB537169 | clade_446 | N | N |
| Brachybacterium tyrofermentans | 403 | NR_026272 | clade_446 | N | N |
| Dermabacter hominis | 749 | FJ263375 | clade_446 | N | N |
| Aneurinibacillus thermoaerophilus | 171 | NR_029303 | clade_448 | N | N |
| Brevibacillus agri | 409 | NR_040983 | clade_448 | N | N |
| Brevibacillus brevis | 410 | NR_041524 | clade_448 | Y | N |
| Brevibacillus centrosporus | 411 | NR_043414 | clade_448 | N | N |
| Brevibacillus choshinensis | 412 | NR_040980 | clade_448 | N | N |
| Brevibacillus invocatus | 413 | NR_041836 | clade_448 | N | N |
| Brevibacillus laterosporus | 414 | NR_037005 | clade_448 | Y | N |
| Brevibacillus parabrevis | 415 | NR_040981 | clade_448 | N | N |
| Brevibacillus reuszeri | 416 | NR_040982 | clade_448 | N | N |
| Brevibacillus sp. phR | 417 | JN837488 | clade_448 | N | N |
| Brevibacillus thermoruber | 418 | NR_026514 | clade_448 | N | N |
| Lactobacillus murinus | 1100 | NR_042231 | clade_449 | N | N |
| Lactobacillus oeni | 1102 | NR_043095 | clade_449 | N | N |
| Lactobacillus ruminis | 1115 | ACGS02000043 | clade_449 | N | N |
| Lactobacillus vini | 1141 | NR_042196 | clade_449 | N | N |
| Gemella haemolysans | 924 | ACDZ02000012 | clade_450 | N | N |
| Gemella morbillorum | 925 | NR_025904 | clade_450 | N | N |
| Gemella morbillorum | 926 | ACRX01000010 | clade_450 | N | N |
| Gemella sanguinis | 927 | ACRY01000057 | clade_450 | N | N |
| Gemella sp. oral clone ASCE02 | 929 | AY923133 | clade_450 | N | N |
| Gemella sp. oral clone ASCF04 | 930 | AY923139 | clade_450 | N | N |
| Gemella sp. oral clone ASCF12 | 931 | AY923143 | clade_450 | N | N |
| Gemella sp. WAL 1945J | 928 | EU427463 | clade_450 | N | N |
| Bacillus coagulans | 206 | DQ297928 | clade_451 | Y | OP |
| Sporolactobacillus inulinus | 1752 | NR_040962 | clade_451 | Y | N |
| Sporolactobacillus nakayamae | 1753 | NR_042247 | clade_451 | N | N |
| Gluconacetobacter entanii | 945 | NR_028909 | clade_452 | N | N |
| Gluconacetobacter europaeus | 946 | NR_026513 | clade_452 | N | N |
| Gluconacetobacter hansenii | 947 | NR_026133 | clade_452 | N | N |
| Gluconacetobacter oboediens | 949 | NR_041295 | clade_452 | N | N |
| Gluconacetobacter xylinus | 950 | NR_074338 | clade_452 | N | N |
| Auritibacter ignavus | 193 | FN554542 | clade_453 | N | N |
| Dermacoccus sp. Ellin185 | 750 | AEIQ01000090 | clade_453 | N | N |
| Janibacter limosus | 1013 | NR_026362 | clade_453 | N | N |
| Janibacter melonis | 1014 | EF063716 | clade_453 | N | N |
| Kocuria palustris | 1041 | EU333884 | clade_453 | Y | N |
| Acetobacter aceti | 7 | NR_026121 | clade_454 | N | N |
| Acetobacter fabarum | 8 | NR_042678 | clade_454 | N | N |
| Acetobacter lovaniensis | 9 | NR_040832 | clade_454 | N | N |
| Acetobacter malorum | 10 | NR_025513 | clade_454 | N | N |
| Acetobacter orientalis | 11 | NR_028625 | clade_454 | N | N |
| Acetobacter pasteurianus | 12 | NR_026107 | clade_454 | N | N |
| Acetobacter pomorum | 13 | NR_042112 | clade_454 | N | N |
| Acetobacter syzygii | 14 | NR_040868 | clade_454 | N | N |
| Acetobacter tropicalis | 15 | NR_036881 | clade_454 | N | N |
| Gluconacetobacter azotocaptans | 943 | NR_028767 | clade_454 | N | N |
| Gluconacetobacter diazotrophicus | 944 | NR_074292 | clade_454 | N | N |
| Gluconacetobacter johannae | 948 | NR_024959 | clade_454 | N | N |
| Nocardia brasiliensis | 1351 | AIHV01000038 | clade_455 | N | N |
| Nocardia cyriacigeorgica | 1352 | HQ009486 | clade_455 | N | N |
| Nocardia farcinica | 1353 | NC_006361 | clade_455 | Y | N |
| Nocardia puris | 1354 | NR_028994 | clade_455 | N | N |
| Nocardia sp. 01_Je_025 | 1355 | GU574059 | clade_455 | N | N |
| Rhodococcus equi | 1623 | ADNW01000058 | clade_455 | N | N |
| Bacillus sp. oral taxon F28 | 247 | HM099650 | clade_456 | Y | OP |

TABLE 1-continued

| OTU | SEQ ID Number | Public DB Accession | Phylogenetic Clade | Spore Former | Pathogen Status |
|---|---|---|---|---|---|
| *Oceanobacillus caeni* | 1358 | NR_041533 | clade_456 | N | N |
| *Oceanobacillus* sr. Ndiop | 1359 | CAER01000083 | clade_456 | N | N |
| *Ornithinibacillus bavariensis* | 1384 | NR_044923 | clade_456 | N | N |
| *Ornithinibacillus* sp. 7_10AIA | 1385 | FN397526 | clade_456 | N | N |
| *Virgibacillus proomii* | 2005 | NR_025308 | clade_456 | N | N |
| *Corynebacterium amycolatum* | 683 | ABZU01000033 | clade_457 | N | OP |
| *Corynebacterium hansenii* | 702 | AM946639 | clade_457 | N | N |
| *Corynebacterium xerosis* | 735 | FN179330 | clade_457 | N | OP |
| Staphylococcaceae bacterium NML 92_0017 | 1756 | AY841362 | clade_458 | N | N |
| *Staphylococcus fleurettii* | 1766 | NR_041326 | clade_458 | N | N |
| *Staphylococcus sciuri* | 1774 | NR_025520 | clade_458 | N | N |
| *Staphylococcus vitulinus* | 1779 | NR_024670 | clade_458 | N | N |
| *Stenotrophomonas maltophilia* | 1782 | AAVZ01000005 | clade_459 | N | N |
| *Stenotrophomonas* sp. FG_6 | 1783 | EF017810 | clade_459 | N | N |
| *Mycobacterium africanum* | 1270 | AF480605 | clade_46 | N | OP |
| *Mycobacterium alsiensis* | 1271 | AJ938169 | clade_46 | N | OP |
| *Mycobacterium avium* | 1272 | CP000479 | clade_46 | N | OP |
| *Mycobacterium colombiense* | 1274 | AM062764 | clade_46 | N | OP |
| *Mycobacterium gordonae* | 1276 | GU142930 | clade_46 | N | OP |
| *Mycobacterium intracellulare* | 1277 | GQ153276 | clade_46 | N | OP |
| *Mycobacterium kansasii* | 1278 | AF480601 | clade_46 | N | OP |
| *Mycobacterium lacus* | 1279 | NR_025175 | clade_46 | N | OP |
| *Mycobacterium leprae* | 1280 | FM211192 | clade_46 | N | OP |
| *Mycobacterium lepromatosis* | 1281 | EU203590 | clade_46 | N | OP |
| *Mycobacterium mantenii* | 1283 | FJ042897 | clade_46 | N | OP |
| *Mycobacterium marinum* | 1284 | NC_010612 | clade_46 | N | OP |
| *Mycobacterium microti* | 1285 | NR_025234 | clade_46 | N | OP |
| *Mycobacterium parascrofulaceum* | 1287 | ADNV01000350 | clade_46 | N | OP |
| *Mycobacterium seoulense* | 1290 | DQ536403 | clade_46 | N | OP |
| *Mycobacterium* sp. 1761 | 1292 | EU703150 | clade_46 | N | N |
| *Mycobacterium* sp. 1791 | 1295 | EU703148 | clade_46 | N | N |
| *Mycobacterium* sp. 1797 | 1296 | EU703149 | clade_46 | N | N |
| *Mycobacterium* sp. B10_07.09.0206 | 1298 | HQ174245 | clade_46 | N | N |
| *Mycobacterium* sp. NLA001000736 | 1305 | HM627011 | clade_46 | N | N |
| *Mycobacterium* sp. W | 1306 | DQ437715 | clade_46 | N | N |
| *Mycobacterium tuberculosis* | 1307 | CP001658 | clade_46 | N | Category-C |
| *Mycobacterium ulcerans* | 1308 | AB548725 | clade_46 | N | OP |
| *Mycobacterium vulneris* | 1309 | EU834055 | clade_46 | N | OP |
| *Xanthomonas campestris* | 2016 | EF101975 | clade_461 | N | N |
| *Xanthomonas* sp. kmd_489 | 2017 | EU723184 | clade_461 | N | N |
| *Dietzia natronolimnaea* | 769 | GQ870426 | clade_462 | N | N |
| *Dietzia* sp. BBDP51 | 770 | DQ337512 | clade_462 | N | N |
| *Dietzia* sp. CA149 | 771 | GQ870422 | clade_462 | N | N |
| *Dietzia timorensis* | 772 | GQ870424 | clade_462 | N | N |
| *Gordonia bronchialis* | 951 | NR_027594 | clade_463 | N | N |
| *Gordonia polyisoprenivorans* | 952 | DQ385609 | clade_463 | N | N |
| *Gordonia* sp. KTR9 | 953 | DQ068383 | clade_463 | N | N |
| *Gordonia sputi* | 954 | FJ536304 | clade_463 | N | N |
| *Gordonia terrae* | 955 | GQ848239 | clade_463 | N | N |
| *Leptotrichia goodfellowii* | 1167 | ADAD01000110 | clade_465 | N | N |
| *Leptotrichia* sp. oral clone IK040 | 1174 | AY349387 | clade_465 | N | N |
| *Leptotrichia* sp. oral clone P2PB_51_P1 | 1175 | AY207053 | clade_465 | N | N |
| Bacteroidales genomosp. P7 oral clone MB3_P19 | 264 | DQ003623 | clade_466 | N | N |
| *Butyricimonas virosa* | 454 | AB443949 | clade_466 | N | N |
| *Odoribacter laneus* | 1363 | AB490805 | clade_466 | N | N |
| *Odoribacter splanchnicus* | 1364 | CP002544 | clade_466 | N | N |
| *Capnocytophaga gingivalis* | 478 | ACLQ01000011 | clade_467 | N | N |
| *Capnocytophaga granulosa* | 479 | X97248 | clade_467 | N | N |
| *Capnocytophaga* sp. oral clone AH015 | 483 | AY005074 | clade_467 | N | N |
| *Capnocytophoga* sp. oral strain S3 | 487 | AY005073 | clade_467 | N | N |
| *Capnocytophaga* sp. oral taxon 338 | 488 | AEXX01000050 | clade_467 | N | N |
| *Capnocytophaga canimorsus* | 476 | CP002113 | clade_468 | N | N |
| *Capnocytophoga* sp. oral clone ID062 | 485 | AY349368 | clade_468 | N | N |
| *Catenibacterium mitsuokai* | 495 | AB030224 | clade_469 | Y | N |
| *Clostridium* sp. TM_40 | 640 | AB249652 | clade_469 | Y | N |
| *Coprobacillus cateniformis* | 670 | AB030218 | clade_469 | Y | N |
| *Coprobacillus* sp. 29_1 | 671 | ADKX01000057 | clade_469 | Y | N |
| *Lactobacillus catenaformis* | 1075 | M23729 | clade_469 | N | N |
| *Lactobacillus vitulinus* | 1142 | NR_041305 | clade_469 | N | N |
| *Cetobacterium somerae* | 501 | AJ438155 | clade_470 | N | N |
| *Clostridium rectum* | 618 | NR_029271 | clade_470 | Y | N |
| *Fusobacterium gonidiaformans* | 896 | ACET01000043 | clade_470 | N | N |
| *Fusobacterium mortiferum* | 897 | ACDB02000034 | clade_470 | N | N |
| *Fusobacterium necrogenes* | 899 | X55408 | clade_470 | N | N |
| *Fusobacterium necrophorum* | 900 | AM905356 | clade_470 | N | N |

TABLE 1-continued

| OTU | SEQ ID Number | Public DB Accession | Phylogenetic Clade | Spore Former | Pathogen Status |
|---|---|---|---|---|---|
| *Fusobacterium* sp. 12_1B | 905 | AGWJ01000070 | clade_470 | N | N |
| *Fusobacterium* sp. 3_1_5R | 911 | ACDD01000078 | clade_470 | N | N |
| *Fusobacterium* sp. D12 | 918 | ACDG02000036 | clade_470 | N | N |
| *Fusobacterium ulcerans* | 921 | ACDH01000090 | clade_470 | N | N |
| *Fusobacterium varium* | 922 | ACIE01000009 | clade_470 | N | N |
| *Mycoplasma arthritidis* | 1312 | NC_011025 | clade_473 | N | N |
| *Mycoplasma faucium* | 1314 | NR_024983 | clade_473 | N | N |
| *Mycoplasma hominis* | 1318 | AF443616 | clade_473 | N | N |
| *Mycoplasma orale* | 1319 | AY796060 | clade_473 | N | N |
| *Mycoplasma salivarium* | 1324 | M24661 | clade_473 | N | N |
| *Mitsuokella jalaludinii* | 1247 | NR_028840 | clade_474 | N | N |
| *Mitsuokella multacida* | 1248 | ABWK02000005 | clade_474 | N | N |
| *Mitsuokella* sp. oral taxon 521 | 1249 | GU413658 | clade_474 | N | N |
| *Mitsuokella* sp. oral taxon G68 | 1250 | GU432166 | clade_474 | N | N |
| *Selenomonas* genomosp. C1 | 1695 | AY278627 | clade_474 | N | N |
| *Selenomonas* genomosp. P8 oral clone MB5_P06 | 1700 | DQ003628 | clade_474 | N | N |
| *Selenomonas ruminantium* | 1703 | NR_075026 | clade_474 | N | N |
| Veillonellaceae bacterium oral taxon 131 | 1994 | GU402916 | clade_474 | N | N |
| *Alloscardoria omnicolens* | 139 | NR_042583 | clade_475 | N | N |
| *Alloscardovia* sp. OB7196 | 140 | AB425070 | clade_475 | N | N |
| *Bifidobacterium urinalis* | 366 | AJ278695 | clade_475 | N | N |
| *Eubacterium nodatum* | 854 | U13041 | clade_476 | Y | N |
| *Eubacterium saphenum* | 859 | NR_026031 | clade_476 | Y | N |
| *Eubacterium* sp. oral clone JH012 | 867 | AY349373 | clade_476 | Y | N |
| *Eubacterium* sp. oral clone JS001 | 870 | AY349378 | clade_476 | Y | N |
| *Faecalibacterium prausnitzii* | 880 | ACOP02000011 | clade_478 | Y | N |
| *Gemmiger formicilis* | 932 | GU562446 | clade_478 | Y | N |
| *Subdoligranulum variabile* | 1896 | AJ518869 | clade_478 | Y | N |
| Clostridiaceae bacterium JC13 | 532 | JF824807 | clade_479 | Y | N |
| *Clostridium* sp. MLG055 | 634 | AF304435 | clade_479 | Y | N |
| Erysipelotrichaceae bacterium 3_1_53 | 822 | ACTJ01000113 | clade_479 | Y | N |
| *Prevotella loescheii* | 1503 | JN867231 | clade_48 | N | N |
| *Prevotella* sp. oral clone ASCG12 | 1530 | DQ272511 | clade_48 | N | N |
| *Prevotella* sp. oral clone GU027 | 1540 | AY349398 | clade_48 | N | N |
| *Prevotella* sp. oral taxon 472 | 1553 | ACZS01000106 | clade_48 | N | N |
| *Selenomonas dianae* | 1693 | GQ422719 | clade_480 | N | N |
| *Selenomonas flueggei* | 1694 | AF287803 | clade_480 | N | N |
| *Selenomonas* genomosp. C2 | 1696 | AY278628 | clade_480 | N | N |
| *Selenomonas* genomosp. P6 oral clone MB3_C41 | 1698 | DQ003636 | clade_480 | N | N |
| *Selenomonas* genomosp. P7 oral clone MB5_C08 | 1699 | DQ003627 | clade_480 | N | N |
| *Selenomonas infelix* | 1701 | AF287802 | clade_480 | N | N |
| *Selenomonas noxia* | 1702 | GU470909 | clade_480 | N | N |
| *Selenomonas* sp. oral clone FT050 | 1705 | AY349403 | clade_480 | N | N |
| *Selenomonas* sp. oral clone GI064 | 1706 | AY349404 | clade_480 | N | N |
| *Selenomonas* sp. oral clone GT010 | 1707 | AY349405 | clade_480 | N | N |
| *Selenomonas* sp. oral clone HU051 | 1708 | AY349406 | clade_480 | N | N |
| *Selenomonas* sp. oral clone IK004 | 1709 | AY349407 | clade_480 | N | N |
| *Selenomonas* sp. oral clone JI021 | 1711 | AY349409 | clade_480 | N | N |
| *Selenomonas* sp. oral clone JS031 | 1712 | AY349410 | clade_480 | N | N |
| *Selenomonas* sp. oral clone OH4A | 1713 | AY947498 | clade_480 | N | N |
| *Selenomonas* sp. oral clone P2PA_80 P4 | 1714 | AY207052 | clade_480 | N | N |
| *Selenomonas* sp. oral taxon 149 | 1716 | AEEJ01000007 | clade_480 | N | N |
| Veillonellaceae bacterium oral taxon 155 | 1995 | GU470897 | clade_480 | N | N |
| *Clostridium cocleatum* | 575 | NR_026495 | clade_481 | Y | N |
| *Clostridium ramosum* | 617 | M23731 | clade_481 | Y | N |
| *Clostridium saccharogumia* | 619 | DQ100445 | clade_481 | Y | N |
| *Clostridium spiroforme* | 644 | X73441 | clade_481 | Y | N |
| *Coprobacillus* sp. D7 | 672 | ACDT01000199 | clade_481 | Y | N |
| Clostridiales bacterium SY8519 | 535 | AB477431 | clade_482 | Y | N |
| *Clostridium* sp. SY8519 | 639 | AP012212 | clade_482 | Y | N |
| *Eubacterium ramulus* | 855 | AJ011522 | clade_482 | Y | N |
| *Agrococcus jenensis* | 117 | NR_026275 | clade_484 | Y | N |
| *Microbacterium gubbeenense* | 1232 | NR_025098 | clade_484 | N | N |
| *Pseudoclavibacter* sp. Timone | 1590 | FJ375951 | clade_484 | N | N |
| *Tropheryma whipplei* | 1961 | BX251412 | clade_484 | N | N |
| *Zimmermannella bifida* | 2031 | AB012592 | clade_484 | N | N |
| *Erysipelothrix inopinata* | 819 | NR_025594 | clade_485 | Y | N |
| *Erysipelothrix rhusiopathiae* | 820 | ACLK01000021 | clade_485 | Y | N |
| *Erysipelothrix tonsillarum* | 821 | NR_040871 | clade_485 | Y | N |
| *Holdemania filiformis* | 1004 | Y11466 | clade_485 | Y | N |
| Mollicutes bacterium pACH93 | 1258 | AY297808 | clade_485 | Y | N |
| *Coxiella burnetii* | 736 | CP000890 | clade_486 | Y | Category-B |
| *Legionella hackeliae* | 1151 | M36028 | clade_486 | N | OP |
| *Legionella longbeachae* | 1152 | M36029 | clade_486 | N | OP |

TABLE 1-continued

| OTU | SEQ ID Number | Public DB Accession | Phylogenetic Clade | Spore Former | Pathogen Status |
|---|---|---|---|---|---|
| Legionella sp. D3923 | 1154 | JN380999 | clade_486 | N | OP |
| Legionella sp. D4088 | 1155 | JN381012 | clade_486 | N | OP |
| Legionella sp. H63 | 1156 | JF831047 | clade_486 | N | OP |
| Legionella sp. NML 93L054 | 1157 | GU062706 | clade_486 | N | OP |
| Legionella steelei | 1158 | HQ398202 | clade_486 | N | OP |
| Tatlockia micdadei | 1915 | M36032 | clade_486 | N | N |
| Clostridium hiranonis | 591 | AB023970 | clade_487 | Y | N |
| Clostridium irregulare | 596 | NR_029249 | clade_487 | Y | N |
| Helicobacter pullorum | 996 | ABQU01000097 | clade_489 | N | N |
| Acetobacteraceae bacterium AT_5844 | 16 | AGEZ01000040 | clade_490 | N | N |
| Roseomonas cervicalis | 1643 | ADVL01000363 | clade_490 | N | N |
| Roseomonas mucosa | 1644 | NR_028857 | clade_490 | N | N |
| Roseomonas sp. NML94_0193 | 1645 | AF533357 | clade_490 | N | N |
| Roseomonas sp. NML97_0121 | 1646 | AF533359 | clade_490 | N | N |
| Roseornonas sp. NML98_0009 | 1647 | AF533358 | clade_490 | N | N |
| Roseomonas sp. NML98_0157 | 1648 | AF533360 | clade_490 | N | N |
| Rickettsia akari | 1627 | CP000847 | clade_492 | N | OP |
| Rickettsia conorii | 1628 | AE008647 | clade_492 | N | OP |
| Rickettsia prowazekii | 1629 | M21789 | clade_492 | N | Category-B |
| Rickettsia rickettsii | 1630 | NC_010263 | clade_492 | N | OP |
| Rickettsia slovaca | 1631 | L36224 | clade_492 | N | OP |
| Rickettsia typhi | 1632 | AE017197 | clade_492 | N | OP |
| Anaeroglobus geminatus | 160 | AGCJ01000054 | clade_493 | N | N |
| Megasphaera genomosp, C1 | 1201 | AY278622 | clade_493 | N | N |
| Megasphaera micronuciformis | 1203 | AECS01000020 | clade_493 | N | N |
| Clostridium orbiscindens | 609 | Y18187 | clade_494 | Y | N |
| Clostridium sp. NML 04A032 | 637 | EU815224 | clade_494 | Y | N |
| Flavonifractor plautii | 886 | AY724678 | clade_494 | Y | N |
| Pseudoflavonifractor capillosus | 1591 | AY136666 | clade_494 | Y | N |
| Ruminococcaceae bacterium D16 | 1655 | ADDX01000083 | clade_494 | Y | N |
| Acetivibrio cellulolyticus | 5 | NR_025917 | clade_495 | Y | N |
| Clostridiales genomsp. BVAB3 | 540 | CP001850 | clade_495 | N | N |
| Clostridium aldrichii | 548 | NR_026099 | clade_495 | Y | N |
| Clostridium clariflavum | 570 | NR_041235 | clade_495 | Y | N |
| Clostridium stercorarium | 647 | NR_025100 | clade_495 | Y | N |
| Clostridium straminisolvens | 649 | NR_024829 | clade_495 | Y | N |
| Clostridium thermocellum | 655 | NR_074629 | clade_495 | Y | N |
| Tsukamurella paurometabola | 1963 | X80628 | clade_496 | N | N |
| Tsukamurella tyrosinosolvens | 1964 | AB478958 | clade_496 | N | N |
| Abiotrophia para_adiacens | 2 | AB022027 | clade_497 | N | N |
| Carnobacterium divergens | 492 | NR_044706 | clade_497 | N | N |
| Carnobacterium maltaromaticum | 493 | NC_019425 | clade_497 | N | N |
| Enterococcus avium | 800 | AF133535 | clade_497 | N | N |
| Enterococcus caccae | 801 | AY943820 | clade_497 | N | N |
| Enterococcus casseliflavus | 802 | AEWT01000047 | clade_497 | N | N |
| Enterococcus durans | 803 | AJ276354 | clade_497 | N | N |
| Enterococcus faecalis | 804 | AE016830 | clade_497 | N | N |
| Enterococcus faecium | 805 | AM157434 | clade_497 | N | N |
| Enterococcus gallinarum | 806 | AB269767 | clade_497 | N | N |
| Enterococcus gilvus | 807 | AY033814 | clade_497 | N | N |
| Enterococcus hawaiiensis | 808 | AY321377 | clade_497 | N | N |
| Enterococcus hirae | 809 | AF061011 | clade_497 | N | N |
| Enterococcus italicus | 810 | AEPV01000109 | clade_497 | N | N |
| Enterococcus mundtii | 811 | NR_024906 | clade_497 | N | N |
| Enterococcus raffinosus | 812 | FN600541 | clade_497 | N | N |
| Enterococcus sp. BV2CASA2 | 813 | JN809766 | clade_497 | N | N |
| Enterococcus sp. CCRI 16620 | 814 | GU457263 | clade_497 | N | N |
| Enterococcus sp. F95 | 815 | FJ463817 | clade_497 | N | N |
| Enterococcus sp. RfL6 | 816 | AJ133478 | clade_497 | N | N |
| Enterococcus thailandicus | 817 | AY321376 | clade_497 | N | N |
| Fusobacterium canifelinum | 893 | AY162222 | clade_497 | N | N |
| Fusobacterium genomosp. C1 | 894 | AY278616 | clade_497 | N | N |
| Fusobacterium genomosp. C2 | 895 | AY278617 | clade_497 | N | N |
| Fusobacterium nucleatum | 901 | ADVK01000034 | clade_497 | Y | N |
| Fusobacterium periodonticum | 902 | ACJY01000002 | clade_497 | N | N |
| Fusobacterium sp. 1_1_41FAA | 906 | ADGG01000053 | clade_497 | N | N |
| Fusobacterium sp. 11_3_2 | 904 | ACUO01000052 | clade_497 | N | N |
| Fusobacterium sp. 2_1_31 | 907 | ACDC02000018 | clade_497 | N | N |
| Fusobacterium sp. 3_1_27 | 908 | ADGF01000045 | clade_497 | N | N |
| Fusobacterium sp. 3_1_33 | 909 | ACQE01000178 | clade_497 | N | N |
| Fusobacterium sp. 3_1_36A2 | 910 | ACPU01000044 | clade_497 | N | N |
| Fusobacterium sp. AC18 | 912 | HQ616357 | clade_497 | N | N |
| Fusobacterium sp. ACB2 | 913 | HQ616358 | clade_497 | N | N |
| Fusobacterium sp. AS2 | 914 | HQ616361 | clade_497 | N | N |
| Fusobacterium sp. CM1 | 915 | HQ616371 | clade_497 | N | N |
| Fusobacterium sp. CM21 | 916 | HQ616375 | clade_497 | N | N |
| Fusobacterium sp. CM22 | 917 | HQ616376 | clade_497 | N | N |

TABLE 1-continued

| OTU | SEQ ID Number | Public DB Accession | Phylogenetic Clade | Spore Former | Pathogen Status |
|---|---|---|---|---|---|
| *Fusobacterium* sp. oral clone ASCF06 | 919 | AY923141 | clade_497 | N | N |
| *Fusobacterium* sp. oral clone ASCF11 | 920 | AY953256 | clade_497 | N | N |
| *Granulicatella adiacens* | 959 | ACKZ01000002 | clade_497 | N | N |
| *Granulicatella elegans* | 960 | AB252689 | clade_497 | N | N |
| *Granulicatella paradiacens* | 961 | AY879298 | clade_497 | N | N |
| *Granulicatella* sp. oral clone ASC02 | 963 | AY923126 | clade_497 | N | N |
| *Granulicatella* sp. oral clone ASCA05 | 964 | DQ341469 | clade_497 | N | N |
| *Granulicatella* sp. oral clone ASCB09 | 965 | AY953251 | clade_497 | N | N |
| *Granulicatella* sp. oral. clone ASCG05 | 966 | AY923146 | clade_497 | N | N |
| *Tetragenococcus halophilus* | 1918 | NR_075020 | clade_497 | N | N |
| *Tetragenococcus koreensis* | 1919 | NR_043113 | clade_497 | N | N |
| *Vagococcus fluvialis* | 1973 | NR_026489 | clade_497 | N | N |
| *Chryseobacterium anthropi* | 514 | AM982793 | clade_498 | N | N |
| *Chryseobacterium gleum* | 515 | ACKQ02000003 | clade_498 | N | N |
| *Chryseobacterium hominis* | 516 | NR_042517 | clade_498 | N | N |
| *Treponema refringens* | 1936 | AF426101 | clade_499 | N | OP |
| *Treponema* sp. oral clone JU031 | 1941 | AY349416 | clade_499 | N | N |
| *Treponema* sp. oral taxon 239 | 1948 | GU408738 | clade_499 | N | N |
| *Treponema* sp. oral taxon 271 | 1955 | GU408871 | clade_499 | N | N |
| *Alistipes finegoldii* | 129 | NR_043064 | clade_500 | N | N |
| *Alistipes onderdonkii* | 131 | NR_043318 | clade_500 | N | N |
| *Alistipes putredinis* | 132 | ABFK02000017 | clade_500 | N | N |
| *Alistipes shahii* | 133 | FP929032 | clade_500 | N | N |
| *Alistipes* sp. HGB5 | 134 | AENZ01000082 | clade_500 | N | N |
| *Alistipes* sp. JC50 | 135 | JF824804 | clade_500 | N | N |
| *Alistipes* sp. RMA 9912 | 136 | GQ140629 | clade_500 | N | N |
| *Mycoplasma agalactiae* | 1310 | AF010477 | clade_501 | N | N |
| *Mycoplasma bovoculi* | 1313 | NR_025987 | clade_501 | N | N |
| *Mycoplasma fermentans* | 1315 | CP002458 | clade_501 | N | N |
| *Mycoplasma flocculare* | 1316 | X62699 | clade_501 | N | N |
| *Mycoplasma ovipneumoniae* | 1320 | NR_025989 | clade_501 | N | N |
| *Arcobacter butzleri* | 176 | AEPT01000071 | clade_502 | N | N |
| *Arcobacter cryaerophilus* | 177 | NR_025905 | clade_502 | N | N |
| *Campylobacter curvus* | 461 | NC_009715 | clade_502 | N | OP |
| *Campylobacter rectus* | 467 | ACFU01000050 | clade_502 | N | OP |
| *Campylobacter showae* | 468 | ACVQ01000030 | clade_502 | N | OP |
| *Campylobacter* sp. FOBRC14 | 469 | HQ616379 | clade_502 | N | OP |
| *Campylobacter* sp. FOBRC15 | 470 | HQ616380 | clade_502 | N | OP |
| *Campylobacter* sp. oral clone BB120 | 471 | AY005038 | clade_502 | N | OP |
| *Campylobacter sputorum* | 472 | NR_044839 | clade_502 | N | OP |
| *Bacteroides ureolyticus* | 330 | GQ167666 | clade_504 | N | N |
| *Campylobacter gracilis* | 463 | ACYG01000026 | clade_504 | N | OP |
| *Campylobacter hominis* | 464 | NC_009714 | clade_504 | N | OP |
| *Dialister invisus* | 762 | ACIM02000001 | clade_506 | N | N |
| *Dialister micraerophilus* | 763 | AFBB01000028 | clade_506 | N | N |
| *Dialister microaerophilus* | 764 | AENT01000008 | clade_506 | N | N |
| *Dialister propionicifaciens* | 766 | NR_043231 | clade_506 | N | N |
| *Dialister succinatiphilus* | 768 | AB370249 | clade_506 | N | N |
| *Megasphaera elsdenii* | 1200 | AY038996 | clade_506 | N | N |
| *Megasphaera* genomosp. type_1 | 1202 | ADGP01000010 | clade_506 | N | N |
| *Megasphaera* sp. BLPYG_07 | 1204 | HM990964 | clade_506 | N | N |
| *Megasphaera* sp. UPII 199_6 | 1205 | AFIJ01000040 | clade_506 | N | N |
| *Chromobacterium violaceum* | 513 | NC_005085 | clade_507 | N | N |
| *Laribacter hongkongensis* | 1148 | CP001154 | clade_507 | N | N |
| *Methylophilus* sp. ECd5 | 1279 | AY436794 | clade_507 | N | N |
| *Finegoldia magna* | 883 | ACHM02000001 | clade_509 | N | N |
| *Parvimonas micra* | 1431 | AB729072 | clade_509 | N | N |
| *Parvimonas* sp. oral taxon 110 | 1432 | AFII01000002 | clade_509 | N | N |
| *Peptostreptococcus micros* | 1456 | AM176538 | clade_509 | N | N |
| *Peptostreptococcus* sp. oral clone FJ023 | 1460 | AY349390 | clade_509 | N | N |
| *Peptostreptococcus* sp. P4P_31_P3 | 1458 | AY207059 | clade_509 | N | N |
| *Helicobacter pylori* | 997 | CP00001.2 | clade_510 | N | OP |
| *Anaplasma marginale* | 165 | ABOR01000019 | clade_511 | N | N |
| *Anaplasma phagocytophilum* | 166 | NC_007797 | clade_511 | N | N |
| *Ehrlichia chaffeensis* | 783 | AAIF01000035 | clade_511 | N | OP |
| *Neorickettsia risticii* | 1349 | CP001431 | clade_511 | N | N |
| *Neorickettsia sennetsu* | 1350 | NC_007798 | clade_511 | N | N |
| *Eubacterium barkeri* | 834 | NR_044661 | clade_512 | Y | N |
| *Eubacterium callanderi* | 838 | NR_026310 | clade_512 | N | N |
| *Eubacterium limosum* | 850 | CP002273 | clade_512 | Y | N |
| *Pseudoramibacter alactolyticus* | 1606 | AB036759 | clade_512 | N | N |
| *Veillonella montpellierensis* | 1977 | AF473836 | clade_513 | N | N |
| *Veillonella* sp. oral clone ASCA08 | 1988 | AY923118 | clade_513 | N | N |
| *Veillonella* sp. oral clone ASCB03 | 1989 | AY923122 | clade_513 | N | N |
| *Inquilinus limosus* | 1012 | NR_029046 | clade_514 | N | N |
| *Sphingomonas* sp. oral clone FZ016 | 1746 | AY349412 | clade_514 | N | N |
| *Anaerococcus lactolyticus* | 145 | ABYO01000217 | clade_515 | N | N |

TABLE 1-continued

| OTU | SEQ ID Number | Public DB Accession | Phylogenetic Clade | Spore Former | Pathogen Status |
|---|---|---|---|---|---|
| *Anaerococcus prevotii* | 147 | CP001708 | clade_515 | N | N |
| *Anaerococcus* sp. gpac104 | 152 | AM176528 | clade_515 | N | N |
| *Anaerococcus* sp. gpac126 | 153 | AM176530 | clade_515 | N | N |
| *Anaerococcus* sp. gpac155 | 154 | AM176536 | clade_515 | N | N |
| *Anaerococcus* sp. gpac199 | 155 | AM176539 | clade_515 | N | N |
| *Anaerococcus tetradius* | 157 | ACGC01000107 | clade_515 | N | N |
| *Bacteroides coagulans* | 271 | AB547639 | clade_515 | N | N |
| Clostridiales bacterium 9403326 | 534 | HM587324 | clade_515 | N | N |
| Clostridiales bacterium ph2 | 539 | JN837487 | clade_515 | N | N |
| *Peptostreptococcus* sp. 9succ1 | 1457 | X90471 | clade_515 | N | N |
| *Peptostreptococcus* sp. oral clone AP24 | 1459 | AB175072 | clade_515 | N | N |
| *Tissierella praeacuta* | 1924 | NR_044860 | clade_515 | N | N |
| *Anaerotruncus colihominis* | 164 | ABGD02000021 | clade_516 | Y | N |
| *Clostridium methylpentosum* | 606 | ACEC01000059 | clade_516 | Y | N |
| *Clostridium* sp. YIT 12070 | 642 | AB491208 | clade_516 | Y | N |
| *Hydrogenoanaerobacterium saccharovorans* | 1005 | NR_044425 | clade_516 | Y | N |
| *Ruminococcus albus* | 1656 | AY445600 | clade_516 | Y | N |
| *Ruminococcus flavefaciens* | 1660 | NR_025931 | clade_516 | Y | N |
| *Clostridium haemolyticum* | 589 | NR_024749 | clade_517 | Y | N |
| *Clostridium novyi* | 608 | NR_074343 | clade_517 | Y | N |
| *Clostridium* sp. LMG 16094 | 632 | X95274 | clade_517 | Y | N |
| *Helicobacter canadensis* | 994 | ABQS01000108 | clade_518 | N | N |
| *Eubacterium ventriosum* | 874 | L34421 | clade_519 | Y | N |
| *Peptostreptococcus anaerobius* | 1455 | AY326462 | clade_520 | N | N |
| *Peptostreptococcus stomatis* | 1461 | ADGQ01000048 | clade_520 | N | N |
| *Bilophila wadsworthia* | 367 | ADCP01000166 | clade_521 | N | N |
| *Desulfovibrio vulgaris* | 761 | NR_074897 | clade_521 | N | N |
| *Bacteroides galacturonicus* | 280 | DQ497994 | clade_522 | Y | N |
| *Eubacterium eligens* | 845 | CP001104 | clade_522 | Y | N |
| *Lachnospira multipara* | 1046 | FR733699 | clade_522 | Y | N |
| *Lachnospira pectinoschiza* | 1047 | L14675 | clade_522 | Y | N |
| *Lactobacillus rogosae* | 1114 | GU269544 | clade_522 | Y | N |
| *Actinomyces nasicola* | 64 | AJ508455 | clade_523 | N | N |
| *Cellulosimicrobium funkei* | 500 | AY501364 | clade_523 | N | N |
| *Lactococcus raffinolactis* | 1146 | NR_044359 | clade_524 | N | N |
| *Bacillus horti* | 214 | NR_036860 | clade_527 | Y | OP |
| *Bacillus* sp. 9_3AIA | 232 | FN397519 | clade_527 | Y | OP |
| Bacteroidales genomosp. P1 | 258 | AY341819 | clade_529 | N | N |
| Bacteroidales genomosp. P2 oral clone MB1_G13 | 259 | DQ003613 | clade_529 | N | N |
| Bacteroidales genomosp. P3 oral clone MB1_G34 | 260 | DQ003615 | clade_529 | N | N |
| Bacteroidales genomosp. P4 oral clone MB2_G17 | 261 | DQ003617 | clade_529 | N | N |
| Bacteroidales genomosp. P5 oral clone MB2_P04 | 262 | DQ003619 | clade_529 | N | N |
| Bacteroidales genomosp. P6 oral clone MB3_C19 | 263 | DQ003634 | clade_529 | N | N |
| Bacteroidales genomosp. P8 oral clone MB4_G15 | 265 | DQ003626 | clade_529 | N | N |
| Bacteroidetes bacterium oral taxon D27 | 333 | HM099638 | clade_530 | N | N |
| Bacteroidetes bacterium oral taxon F31 | 334 | HM099643 | clade_530 | N | N |
| Bacteroidetes bacterium oral taxon F44 | 335 | HM099649 | clade_530 | N | N |
| *Flavobacterium* sp. NF2_1 | 885 | FJ195988 | clade_530 | N | N |
| *Myroides odoratimimus* | 1326 | NR_042354 | clade_530 | N | N |
| *Myroides* sp. MY15 | 1327 | GU253339 | clade_530 | N | N |
| Chlamydiales bacterium NS16 | 507 | JN606076 | clade_531 | N | N |
| *Chlamydophila pecorum* | 508 | D88317 | clade_531 | N | OP |
| *Parachlamydia* sp. UWE25 | 1423 | BX908798 | clade_531 | N | N |
| *Fusobacterium russii* | 903 | NR_044687 | clade_532 | N | N |
| *Streptobacillus moniliformis* | 1784 | NR_027615 | clade_532 | N | N |
| Eubacteriaceae bacterium P4P_50 P4 | 833 | AY207060 | clade_533 | N | N |
| *Eubacterium brachy* | 836 | U13038 | clade_533 | Y | N |
| *Filifactor alocis* | 881 | CP002390 | clade_533 | Y | N |
| *Filifactor villosus* | 882 | NR_041928 | clade_533 | Y | N |
| *Abiotrophia defectiva* | 1 | ACIN02000016 | clade_534 | N | N |
| *Abiotrophia* sp. oral clone P4PA_155 P1 | 3 | AY207063 | clade_534 | N | N |
| *Catonella* genomosp. P1 oral clone MB5_P12 | 496 | DQ003629 | clade_534 | N | N |
| *Catonella morbi* | 497 | ACIL02000016 | clade_534 | N | N |
| *Catonella* sp. oral clone FL037 | 498 | AY349369 | clade_534 | N | N |
| *Eremococcus coleocola* | 818 | AENN01000008 | clade_534 | N | N |
| *Facklamia hominis* | 879 | Y10772 | clade_534 | N | N |
| *Granulicatella* sp. M658_99_3 | 962 | AJ271861 | clade_534 | N | N |
| *Campylobacter coli* | 459 | AAFL01000004 | clade_535 | N | OP |
| *Campylobacter concisus* | 460 | CP000792 | clade_535 | N | OP |
| *Campylobacter fetus* | 462 | ACLG01001177 | clade_535 | N | OP |

TABLE 1-continued

| OTU | SEQ ID Number | Public DB Accession | Phylogenetic Clade | Spore Former | Pathogen Status |
|---|---|---|---|---|---|
| Campylobacter jejuni | 465 | AL139074 | clade_535 | N | Category-B |
| Campylobacter upsaliensis | 473 | AEPU01000040 | clade_535 | N | OP |
| Clostridium leptum | 601 | AJ305238 | clade_537 | Y | N |
| Clostridium sp. YIT 12069 | 641 | AB491207 | clade_537 | Y | N |
| Clostridium sporosphaeroides | 646 | NR_044835 | clade_537 | Y | N |
| Eubacterium coprostanoligenes | 841 | HM037995 | clade_537 | Y | N |
| Ruminococcus bromii | 1657 | EU266549 | clade_537 | Y | N |
| Eubacterium siraeum | 860 | ABCA03000054 | clade_538 | Y | N |
| Atopobium minutum | 183 | HM007583 | clade_539 | N | N |
| Atopobium parvulum | 184 | CP001721 | clade_539 | N | N |
| Atopobium rimae | 185 | ACFE01000007 | clade_539 | N | N |
| Atopobium sp. BS2 | 186 | HQ616367 | clade_539 | N | N |
| Atopobium sp. F0209 | 187 | EU592966 | clade_539 | N | N |
| Atopobium sp. ICM42b10 | 188 | HQ616393 | clade_539 | N | N |
| Atopobium sp. ICM57 | 189 | HQ616400 | clade_539 | N | N |
| Atopobium vaginae | 190 | AEDQ01000024 | clade_539 | N | N |
| Coriobacteriaceae bacterium BV3Ac1 | 677 | JN809768 | clade_539 | N | N |
| Actinomyces naeslundii | 63 | X81062 | clade_54 | N | N |
| Actinomyces oricola | 67 | NR_025559 | clade_54 | N | N |
| Actinomyces oris | 69 | BABV01000070 | clade_54 | N | N |
| Actinomyces sp. 7400942 | 70 | EU484334 | clade_54 | N | N |
| Actinomyces sp. ChDC B197 | 72 | AF543275 | clade_54 | N | N |
| Actinomyces sp. GEJ15 | 73 | GU561313 | clade_54 | N | N |
| Actinomyces sp. M2231_94_1 | 79 | AJ234063 | clade_54 | N | N |
| Actinomyces sp. oral clone GU067 | 83 | AY349362 | clade_54 | N | N |
| Actinomyces sp. oral clone IO077 | 85 | AY349364 | clade_54 | N | N |
| Actinomyces sp. oral clone IP073 | 86 | AY349365 | clade_54 | N | N |
| Actinomyces sp. oral clone JA063 | 88 | AY349367 | clade_54 | N | N |
| Actinomyces sp. oral taxon 170 | 89 | AFBL01000010 | clade_54 | N | N |
| Actinomyces sp. oral taxon 171 | 90 | AECW01000034 | clade_54 | N | N |
| Actinomyces urogenitalis | 95 | ACFH01000038 | clade_54 | N | N |
| Actinomyces viscosus | 96 | ACRE01000096 | clade_54 | N | N |
| Clostridium viride | 657 | NR_026204 | clade_540 | Y | N |
| Oscillibacter sp. G2 | 1386 | HM626173 | clade_540 | Y | N |
| Oscillibacter valericigenes | 1387 | NR_074793 | clade_540 | Y | N |
| Oscillospira guilliermondii | 1388 | AB040495 | clade_540 | Y | N |
| Orientia tsutsugamushi | 1383 | AP008981 | clade_541 | N | OP |
| Megamonas funiformis | 1198 | AB300988 | clade_542 | N | N |
| Megamonas hypermegale | 1199 | AJ420107 | clade_542 | N | N |
| Butyrivibrio crossotus | 455 | ABWN01000012 | clade_543 | Y | N |
| Clostridium sp. L2_50 | 631 | AAYW02000018 | clade_543 | Y | N |
| Coprococcus eutactus | 675 | EF031543 | clade_543 | Y | N |
| Coprococcus sp. ART55_1 | 676 | AY350746 | clade_543 | Y | N |
| Eubacterium ruminantium | 857 | NR_024661 | clade_543 | Y | N |
| Aeromicrobium marinum | 102 | NR_025681 | clade_544 | N | N |
| Aeromicrobium sp. JC14 | 103 | JF824798 | clade_544 | N | N |
| Luteococcus sanguinis | 1190 | NR_025507 | clade_544 | N | N |
| Propionibacteriaceae bacterium NML 02_0265 | 1568 | EF599122 | clade_544 | N | N |
| Rhodococcus corynebacterioides | 1622 | X80615 | clade_546 | N | N |
| Rhodococcus erythropolis | 1624 | ACNO01000030 | clade_546 | N | N |
| Rhodococcus fascians | 1625 | NR_037021 | clade_546 | N | N |
| Segniliparus rotundus | 1690 | CP001958 | clade_546 | N | N |
| Segniliparus rugosus | 1691 | ACZI01000025 | clade_546 | N | N |
| Exiguobacterium acetylicum | 878 | FJ970034 | clade_547 | N | N |
| Micrococcus caseolyticus | 1194 | NR_074941 | clade_547 | N | OP |
| Streptomyces sp. 1 AIP_2009 | 1890 | FJ176782 | clade_548 | N | N |
| Streptomyces sp. SD 524 | 1892 | EU544234 | clade_548 | N | N |
| Streptomyces sp. SD 528 | 1893 | EU544233 | clade_548 | N | N |
| Streptomyces thermoviolaceus | 1895 | NR_027616 | clade_548 | N | N |
| Borrelia afzelii | 388 | ABCU01000001 | clade_549 | N | OP |
| Borrelia crocidurae | 390 | DQ057990 | clade_549 | N | OP |
| Borrelia duttonii | 391 | NC_011229 | clade_549 | N | OP |
| Borrelia hermsii | 393 | AY597657 | clade_549 | N | OP |
| Borrelia hispanica | 394 | DQ057988 | clade_549 | N | OP |
| Borrelia persica | 395 | HM161645 | clade_549 | N | OP |
| Borrelia recurrentis | 396 | AF107367 | clade_549 | N | OP |
| Borrelia spielmanii | 398 | ABKB01000002 | clade_549 | N | OP |
| Borrelia turicatae | 399 | NC_008710 | clade_549 | N | OP |
| Borrelia valaisiana | 400 | ABCY01000002 | clade_549 | N | OP |
| Providencia alcalifaciens | 1586 | ABXW01000071 | clade_55 | N | N |
| Providencia rettgeri | 1587 | AM040492 | clade_55 | N | N |
| Providencia rustigianii | 1588 | AM040489 | clade_55 | N | N |
| Providencia stuartii | 1589 | AF008581 | clade_55 | N | N |
| Treponema pallidum | 1932 | CP001752 | clade_550 | N | OP |
| Treponema phagedenis | 1934 | AEFH01000172 | clade_550 | N | N |
| Treponema sp. clone DDKL_4 | 1939 | Y08894 | clade_550 | N | N |

TABLE 1-continued

| OTU | SEQ ID Number | Public DB Accession | Phylogenetic Clade | Spore Former | Pathogen Status |
|---|---|---|---|---|---|
| *Acholeplasma laidlawii* | 17 | NR_074448 | clade_551 | N | N |
| *Mycoplasma putrefaciens* | 1323 | U26055 | clade_551 | N | N |
| *Mycoplasmataceae genomosp P1 oral clone* | 1325 | DQ003614 | clade_551 | N | N |
| *Spiroplasma insolitum* | 1750 | NR_025705 | clade_551 | N | N |
| *Collinsella aerofaciens* | 659 | AAVN02000007 | clade_553 | Y | N |
| *Collinsella intestinalis* | 660 | ABXH02000037 | clade_553 | N | N |
| *Collinsella stercoris* | 661 | ABXJ01000150 | clade_553 | N | N |
| *Collinsella tanakaei* | 662 | AB490807 | clade_553 | N | N |
| *Alkaliphilus metalliredigenes* | 137 | AY137848 | clade_554 | Y | N |
| *Alkaliphilus oremlandii* | 138 | NR_043674 | clade_554 | Y | N |
| *Caminicella sporogenes* | 458 | NR_025485 | clade_554 | N | N |
| *Clostridium sticklandii* | 648 | L04167 | clade_554 | Y | N |
| *Turicibacter sanguinis* | 1965 | AF349724 | clade_555 | Y | N |
| *Acidaminococcus fermentans* | 21 | CP001859 | clade_556 | N | N |
| *Acidaminococcus intestini* | 22 | CP003058 | clade_556 | N | N |
| *Acidaminococcus sp. D21* | 23 | ACGB01000071 | clade_556 | N | N |
| *Phascolarctobacterium faecium* | 1462 | NR_026111 | clade_556 | N | N |
| *Phascolarctobacterium sp. YIT 12068* | 1463 | AB490812 | clade_556 | N | N |
| *Phascolarctobacterium succinatutens* | 1464 | AB490811 | clade_556 | N | N |
| *Acidithiobacillus ferrivorans* | 25 | NR_074660 | clade_557 | N | N |
| *Fulvimonas sp. NML 060897* | 892 | EF589680 | clade_557 | Y | N |
| *Xanthomonadaceae bacterium NML 03_0222* | 2015 | EU313791 | clade_557 | N | N |
| *Catabacter hongkongensis* | 494 | AB671763 | clade_558 | N | N |
| *Christensenella minuta* | 512 | AB490809 | clade_558 | N | N |
| *Clostridiales bacterium oral clone P4PA* | 536 | AY207065 | clade_558 | N | N |
| *Clostridiales bacterium oral taxon 093* | 537 | GQ422712 | clade_558 | N | N |
| *Desulfitobacterium frappieri* | 753 | AJ276701 | clade_560 | Y | N |
| *Desulfitobacterium hafniense* | 754 | NR_074996 | clade_560 | Y | N |
| *Desulfotomaculum nigrificans* | 756 | NR_044832 | clade_560 | Y | N |
| *Heliobacterium modesticaldum* | 1000 | NR_074517 | clade_560 | N | N |
| *Alistipes indistinctus* | 130 | AB490804 | clade_561 | N | N |
| Bacteroidales bacterium ph8 | 257 | JN837494 | clade_561 | N | N |
| *Candidatus Sulcia muelleri* | 475 | CP002163 | clade_561 | N | N |
| *Cytophaga xylanolytica* | 742 | FR733683 | clade_561 | N | N |
| Flavobacteriaceae genomosp. C1 | 884 | AY278614 | clade_561 | N | N |
| *Gramella forsetii* | 958 | NR_074707 | clade_561 | N | N |
| *Sphingobacterium faecium* | 1740 | NR_025537 | clade_562 | N | N |
| *Sphingobacterium mizutaii* | 1741 | JF708889 | clade_562 | N | N |
| *Sphingobacterium multivorum* | 1742 | NR_040953 | clade_562 | N | N |
| *Sphingobacterium spiritivorum* | 1743 | ACHA02000013 | clade_562 | N | N |
| *Jonquetella anthropi* | 1017 | ACOO02000004 | clade_563 | N | N |
| *Pyramidobacter piscolens* | 1614 | AY207056 | clade_563 | N | N |
| *Synergistes genomosp. C1* | 1904 | AY278615 | clade_563 | N | N |
| *Synergistes sp. RMA 14551* | 1905 | DQ412722 | clade_563 | N | N |
| Synergistetes bacterium ADV897 | 1906 | GQ258968 | clade_563 | N | N |
| *Candidatus Arthromitus sp. SFB_mouse_Yit* | 474 | NR_074460 | clade_564 | N | N |
| *Gracilibacter thermotolerans* | 957 | NR_043559 | clade_564 | N | N |
| *Lutispora thermophila* | 1191 | NR_041236 | clade_564 | Y | N |
| *Brachyspira aalborgi* | 404 | FM178386 | clade_565 | N | N |
| *Brachyspira pilosicoli* | 405 | NR_075069 | clade_565 | Y | N |
| *Brachyspira sp. HIS3* | 406 | FM178387 | clade_565 | N | N |
| *Brachyspira sp. HIS4* | 407 | FM178388 | clade_565 | N | N |
| *Brachyspira sp. HIS5* | 408 | FM178389 | clade_565 | N | N |
| *Adlercreutzia equolifaciens* | 97 | AB306661 | clade_566 | N | N |
| Coriobacteriaceae bacterium JC110 | 678 | CAEM01000062 | clade_566 | N | N |
| Coriobacteriaceae bacterium phI | 679 | JN837493 | clade_566 | N | N |
| *Cryptobacterium curtum* | 740 | GQ422741 | clade_566 | N | N |
| *Eggerthella lenta* | 778 | AF292375 | clade_566 | Y | N |
| *Eggerthella sinensis* | 779 | AY321958 | clade_566 | N | N |
| *Eggerthella sp. 1_3_56FAA* | 780 | ACWN01000099 | clade_566 | N | N |
| *Eggerthella sp. HGA1* | 781 | AEXR01000021 | clade_566 | N | N |
| *Eggerthella sp. YY7918* | 782 | AP012211 | clade_566 | N | N |
| *Gordonibacter pamelaeae* | 680 | AM886059 | clade_566 | N | N |
| *Gordonibacter pamelaeae* | 956 | FP929047 | clade_566 | N | N |
| *Slackia equolifaciens* | 1732 | EU377663 | clade_566 | N | N |
| *Slackia exigua* | 1733 | ACUX01000029 | clade_566 | N | N |
| *Slackia faecicanis* | 1734 | NR_042220 | clade_566 | N | N |
| *Slackia heliotrinireducens* | 1735 | NR_074439 | clade_566 | N | N |
| *Slackia isoflavoniconvertens* | 1736 | AB566418 | clade_566 | N | N |
| *Slackia piriformis* | 1737 | AB490806 | clade_566 | N | N |
| *Slackia sp. NATTS* | 1738 | AB505075 | clade_566 | N | N |
| *Streptomyces albus* | 1888 | AJ697941 | clade_566 | Y | N |
| Chlamydiales bacterium NS11 | 505 | JN606074 | clade_567 | Y | N |
| Chlamydiales bacterium NS13 | 506 | JN606075 | clade_567 | N | N |
| Victivallaceae bacterium NML 080035 | 2003 | FJ394915 | clade_567 | N | N |

TABLE 1-continued

| OTU | SEQ ID Number | Public DB Accession | Phylogenetic Clade | Spore Former | Pathogen Status |
|---|---|---|---|---|---|
| *Victivallis vadensis* | 2004 | ABDE02000010 | clade_567 | N | N |
| *Anaerofustis stercorihominis* | 159 | ABIL02000005 | clade_570 | Y | N |
| *Butyricicoccus pullicaecorum* | 453 | HH793440 | clade_572 | Y | N |
| *Eubacterium desmolans* | 843 | NR_044644 | clade_572 | Y | N |
| *Papillibacter cinnamivorans* | 1415 | NR_025025 | clade_572 | Y | N |
| *Sporobacter termitidis* | 1751 | NR_044972 | clade_572 | Y | N |
| *Streptomyces griseus* | 1889 | NR_074787 | clade_573 | N | N |
| *Streptomyces* sp. SD 511 | 1891 | EU544231 | clade_573 | N | N |
| *Streptomyces* sp. SD 534 | 1894 | EU544232 | clade_573 | N | N |
| *Cloacibacillus evryensis* | 530 | GQ258966 | clade_575 | N | N |
| *Deferribacteres* sp. oral clone JV001 | 743 | AY349370 | clade_575 | N | N |
| *Deferribacteres* sp. oral clone JV006 | 744 | AY349371 | clade_575 | Y | N |
| *Deferribacteres* sp. oral clone JV023 | 745 | AY349372 | clade_575 | N | N |
| Synergistetes bacterium LBVCM1157 | 1907 | GQ258969 | clade_575 | N | N |
| Synergistetes bacterium oral taxon 362 | 1909 | GU410752 | clade_575 | N | N |
| Synergistetes bacterium oral taxon D48 | 1910 | GU430992 | clade_575 | N | N |
| *Clostridium colinum* | 577 | NR_026151 | clade_576 | Y | N |
| *Clostridium lactatifermentans* | 599 | NR_025651 | clade_576 | Y | N |
| *Clostridium piliforme* | 614 | D14639 | clade_576 | Y | N |
| *Peptococcus* sp. oral clone JM048 | 1439 | AY349389 | clade_576 | N | N |
| *Helicobacter winghamensis* | 999 | ACDO01000013 | clade_577 | N | N |
| *Wolinella succinogenes* | 2014 | BX571657 | clade_577 | N | N |
| *Olsenella* genomosp. C1 | 1368 | AY278623 | clade_578 | N | N |
| *Olsenella profusa* | 1369 | FN178466 | clade_578 | N | N |
| *Olsenella* sp. F0004 | 1370 | EU592964 | clade_578 | N | N |
| *Olsenella* sp. oral taxon 809 | 1371 | ACVE01000002 | clade_578 | N | N |
| *Olsenella uli* | 1372 | CP002106 | clade_578 | N | N |
| *Nocardiopsis dassonvillei* | 1356 | CP002041 | clade_579 | N | N |
| *Saccharomonospora viridis* | 1671 | X54286 | clade_579 | Y | N |
| *Thermobifida fusca* | 1921 | NC_007333 | clade_579 | Y | N |
| *Peptococcus niger* | 1438 | NR_029221 | clade_580 | N | N |
| *Peptococcus* sp. oral taxon 167 | 1440 | GQ422727 | clade_580 | N | N |
| *Akkermansia muciniphila* | 118 | CP001071 | clade_583 | N | N |
| *Opitutus terrae* | 1373 | NR_074978 | clade_583 | N | N |
| Clostridiales bacterium oral taxon F32 | 538 | HM099644 | clade_584 | N | N |
| *Leptospira borgpetersenii* | 1161 | NC_008508 | clade_585 | N | OP |
| *Leptospira broomii* | 1162 | NR_043200 | clade_585 | N | OP |
| *Leptospira interrogans* | 3163 | NC_005823 | clade_585 | N | OP |
| *Leptospira licerasiae* | 1164 | EF612284 | clade_585 | Y | OP |
| *Methanobrevibacter gottschalkii* | 1213 | NR_044789 | clade_587 | N | N |
| *Methanobrevibacter millerae* | 1214 | NR_042785 | clade_587 | N | N |
| *Methanobrevibacter oralis* | 1216 | HE654003 | clade_587 | N | N |
| *Methanobrevibacter thaueri* | 1219 | NR_044787 | clade_587 | N | N |
| *Methanobrevibacter smithii* | 1218 | ABYV02000002 | clade_588 | N | N |
| *Deinococcus radiodurans* | 746 | AE000513 | clade_589 | N | N |
| *Deinococcus* sp. R_43890 | 747 | FR682752 | clade_589 | N | N |
| *Thermus aquaticus* | 1923 | NR_025900 | clade_589 | N | N |
| *Actinomyces* sp. c109 | 81 | AB167239 | clade_590 | N | N |
| *Moorella thermoacetica* | 1259 | NR_075001 | clade_590 | Y | N |
| Syntrophomonadaceae genomosp. P1 | 1912 | AY341821 | clade_590 | N | N |
| *Thermoanaerobacter pseudethanolicus* | 1920 | CP000924 | clade_590 | Y | N |
| *Anaerobaculum hydrogeniformans* | 141 | ACJX02000009 | clade_591 | N | N |
| *Flexistipes sinusarabici* | 888 | NR_074881 | clade_591 | Y | N |
| *Microcystis aeruginosa* | 1246 | NC_010296 | clade_592 | N | N |
| *Prochlorococcus marinus* | 1567 | CP000551 | clade_592 | N | N |
| *Methanobrevibacter acididurans* | 1208 | NR_028779 | clade_593 | N | N |
| *Methanobrevibacter arboriphilus* | 1209 | NR_042783 | clade_593 | N | N |
| *Methanobrevibacter curvatus* | 1210 | NR_044796 | clade_593 | N | N |
| *Methanobrevibacter cuticularis* | 1211 | NR_044776 | clade_593 | N | N |
| *Methanobrevibacter filiformis* | 1212 | NR_044801 | clade_593 | N | N |
| *Methanobrevibacter woesei* | 1220 | NR_044788 | clade_593 | N | N |
| *Roseiflexus castenholzii* | 1642 | CP000804 | clade_594 | N | N |
| *Methanobrevibacter olleyae* | 1215 | NR_043024 | clade_595 | N | N |
| *Methanobrevibacter ruminantium* | 1217 | NR_042784 | clade_595 | N | N |
| *Methanobrevibacter wolinii* | 1221 | NR_044790 | clade_595 | N | N |
| *Methanosphaera stadtmanae* | 1222 | AY196684 | clade_595 | N | N |
| Chloroflexi genomosp. P1 | 511 | AY331414 | clade_596 | N | N |
| *Gloeobacter violaceus* | 942 | NR_074282 | clade_596 | Y | N |
| *Halorubrum lipolyticum* | 992 | AB477978 | clade_597 | N | N |
| *Methanobacterium formicicum* | 1207 | NR_025028 | clade_597 | N | N |
| *Acidilobus saccharovorans* | 24 | AY350586 | clade_598 | N | N |
| *Hyperthermus butylicus* | 1006 | CP000493 | clade_598 | N | N |
| *Ignicoccus islandicus* | 1011 | X99562 | clade_598 | N | N |
| *Metallosphaera sedula* | 1206 | D26491 | clade_598 | N | N |
| *Thermofilum pendens* | 1922 | X14835 | clade_598 | N | N |
| *Prevotella melaninogenica* | 1506 | CP002122 | clade_6 | N | N |
| *Prevotella* sp. ICM1 | 1520 | HQ616385 | clade_6 | N | N |

TABLE 1-continued

| OTU | SEQ ID Number | Public DB Accession | Phylogenetic Clade | Spore Former | Pathogen Status |
|---|---|---|---|---|---|
| *Prevotella* sp. oral clone FU048 | 1535 | AY349393 | clade_6 | N | N |
| *Prevotella* sp. oral done GI030 | 1537 | AY349395 | clade_6 | N | N |
| *Prevotella* sp. SEQ116 | 1526 | JN867246 | clade_6 | N | N |
| *Streptococcus anginosus* | 1787 | AECT01000011 | clade_60 | N | N |
| *Streptococcus milleri* | 1812 | X81023 | clade_60 | N | N |
| *Streptococcus* sp. 16362 | 1829 | JN590019 | clade_60 | N | N |
| *Streptococcus* sp. 69130 | 1832 | X78825 | clade_60 | N | N |
| *Streptococcus* sp. AC15 | 1833 | HQ616356 | clade_60 | N | N |
| *Streptococcus* sp. CM7 | 1839 | HQ616373 | clade_60 | N | N |
| *Streptococcus* sp. OBRC6 | 1847 | HQ616352 | clade_60 | N | N |
| *Burkholderia ambifaria* | 442 | AAUZ01000009 | clade_61 | N | OP |
| *Burkholderia cenocepacia* | 443 | AAHI001000060 | clade_61 | N | OP |
| *Burkholderia cepacia* | 444 | NR_041719 | clade_61 | N | OP |
| *Burkholderia mallei* | 445 | CP000547 | clade_61 | N | Category-B |
| *Burkholderia multivorans* | 446 | NC_010086 | clade_61 | N | OP |
| *Burkholderia oklahomensis* | 447 | DQ108388 | clade_61 | N | OP |
| *Burkholderia pseudomallei* | 448 | CP001408 | clade_61 | N | Category-B |
| *Burkholderia rhizoxinica* | 449 | HQ005410 | clade_61 | N | OP |
| *Burkholderia* sp. 383 | 450 | CP000151 | clade_61 | N | OP |
| *Burkholderia xenovorans* | 451 | U86373 | clade_61 | N | OP |
| *Prevotella buccae* | 1488 | ACRB01000001 | clade_62 | N | N |
| *Prevotella* genomosp. P8 oral clone MB3_P13 | 1498 | DQ003622 | clade_62 | N | N |
| *Prevotella* sp. oral clone FW035 | 1536 | AY349394 | clade_62 | N | N |
| *Prevotella bivia* | 1486 | ADFO01000096 | clade_63 | N | N |
| *Prevotella disiens* | 1494 | AEDO01000026 | clade_64 | N | N |
| *Bacteroides faecis* | 276 | GQ496624 | clade_65 | N | N |
| *Bacteroides fragilis* | 279 | AP006841 | clade_65 | N | N |
| *Bacteroides nordii* | 285 | NR_043017 | clade_65 | N | N |
| *Bacteroides salyersiae* | 292 | EU136690 | clade_65 | N | N |
| *Bacteroides* sp. 1_1_14 | 293 | ACRP01000155 | clade_65 | N | N |
| *Bacteroides* sp. 1_1_6 | 295 | ACIC01000215 | clade_65 | N | N |
| *Bacteroides* sp. 2_1_56FAA | 298 | ACWI01000065 | clade_65 | N | N |
| *Bacteroides* sp. AR29 | 316 | AF139525 | clade_65 | N | N |
| *Bacteroides* sp. B2 | 317 | EU722733 | clade_65 | N | N |
| *Bacteroides thetaiotaomicron* | 328 | NR_074277 | clade_65 | N | N |
| *Actinobacillus minor* | 45 | ACFT01000025 | clade_69 | N | N |
| *Haemophilus parasuis* | 978 | GU226366 | clade_69 | N | N |
| *Vibrio cholerae* | 1996 | AAUR01000095 | clade_71 | N | Category-B |
| *Vibrio fluvialis* | 1997 | X76335 | clade_71 | N | Category-B |
| *Vibrio furnissii* | 1998 | CP002377 | clade_71 | N | Category-B |
| *Vibrio mimicus* | 1999 | ADAF01000001 | clade_71 | N | Category-B |
| *Vibrio parahaemolyticus* | 2000 | AAWQ01000116 | clade_71 | N | Category-B |
| *Vibrio* sp. RC341 | 2001 | ACZT01000024 | clade_71 | N | Category-B |
| *Vibrio vulnificus* | 2002 | AE016796 | clade_71 | N | Category-B |
| *Lactobacillus acidophilus* | 1067 | CP000033 | clade_72 | N | N |
| *Lactobacillus amylolyticus* | 1069 | ADNY01000006 | clade_72 | N | N |
| *Lactobacillus amylovorus* | 1070 | CP002338 | clade_72 | N | N |
| *Lactobacillus crispatus* | 1078 | ACOG01000151 | clade_72 | N | N |
| *Lactobacillus delbrueckii* | 1080 | CP002341 | clade_72 | N | N |
| *Lactobacillus helveticus* | 1088 | ACLM01000202 | clade_72 | N | N |
| *Lactobacillus kalixensis* | 1094 | NR_029083 | clade_72 | N | N |
| *Lactobacillus kefiranofaciens* | 1095 | NR_042440 | clade_72 | N | N |
| *Lactobacillus leichmannii* | 1098 | JX986966 | clade_72 | N | N |
| *Lactobacillus* sp. 66c | 1120 | FR681900 | clade_72 | N | N |
| *Lactobacillus* sp. KLDS 1.0701 | 1122 | EU600905 | clade_72 | N | N |
| *Lactobacillus* sp. KLDS 1.0712 | 1130 | EU600916 | clade_72 | N | N |
| *Lactobacillus* sp. oral clone HT070 | 1136 | AY349383 | clade_72 | N | N |
| *Lactobacillus ultunensis* | 1139 | ACGU01000081 | clade_72 | N | N |
| *Prevotella intermedia* | 1502 | AF414829 | clade_81 | N | N |
| *Prevotella nigrescens* | 1511 | AFPX01000069 | clade_81 | N | N |
| *Prevotella pallens* | 1515 | AFPY01000135 | clade_81 | N | N |
| *Prevotella* sp. oral taxon 310 | 1551 | GQ422737 | clade_81 | N | N |
| *Prevotella* genomosp. C1 | 1495 | AY278624 | clade_82 | N | N |
| *Prevotella* sp. CM38 | 1519 | HQ610181 | clade_82 | N | N |
| *Prevotella* sp. oral taxon 317 | 1552 | ACQH01000158 | clade_82 | N | N |
| *Prevotella* sp. SG12 | 1527 | GU561343 | clade_82 | N | N |
| *Prevotella denticola* | 1493 | CP002589 | clade_83 | N | N |
| *Prevotella* genomosp. P7 oral clone MB2_P31 | 1497 | DQ003620 | clade_83 | N | N |
| *Prevotella histicola* | 1501 | JN867315 | clade_83 | N | N |
| *Prevotella multiformis* | 1508 | AEWX01000054 | clade_83 | N | N |
| *Prevotella* sp. JCM 6330 | 1522 | AB547699 | clade_83 | N | N |
| *Prevotella* sp. oral clone GI059 | 1539 | AY349397 | clade_83 | N | N |
| *Prevotella* sp. oral taxon 782 | 1555 | GQ422745 | clade_83 | N | N |
| *Prevotella* sp. oral taxon G71 | 1559 | GU432180 | clade_83 | N | N |
| *Prevotella* sp. SEQ065 | 1524 | JN867234 | clade_83 | N | N |

TABLE 1-continued

| OTU | SEQ ID Number | Public DB Accession | Phylogenetic Clade | Spore Former | Pathogen Status |
|---|---|---|---|---|---|
| *Prevotella veroralis* | 1565 | ACVA01000027 | clade_83 | N | N |
| *Bacteroides acidifaciens* | 266 | NR_028607 | clade_85 | N | N |
| *Bacteroides cellulosilyticus* | 269 | ACCH01000108 | clade_85 | N | N |
| *Bacteroides clarus* | 270 | AFBM01000011 | clade_85 | N | N |
| *Bacteroides eggerthii* | 275 | ACWG01000065 | clade_85 | N | N |
| *Bacteroides oleiciplenus* | 286 | AB547644 | clade_85 | N | N |
| *Bacteroides pyogenes* | 290 | NR_041280 | clade_85 | N | N |
| *Bacteroides* sp. 315_5 | 300 | FJ848547 | clade_85 | N | N |
| *Bacteroides* sp. 31SF15 | 301 | AJ583248 | clade_85 | N | N |
| *Bacteroides* sp. 31SF18 | 302 | AJ583249 | clade_85 | N | N |
| *Bacteroides* sp. 35AE31 | 303 | AJ583244 | clade_85 | N | N |
| *Bacteroides* sp. 35AE37 | 304 | AJ583245 | clade_85 | N | N |
| *Bacteroides* sp. 35BE34 | 305 | AJ583246 | clade_85 | N | N |
| *Bacteroides* sp. 35BE35 | 306 | AJ583247 | clade_85 | N | N |
| *Bacteroides* sp. WH2 | 324 | AY895180 | clade_85 | N | N |
| *Bacteroides* sp. XB12B | 325 | AM230648 | clade_85 | N | N |
| *Bacteroides stercoris* | 327 | ABFZ02000022 | clade_85 | N | N |
| *Actinobacillus pleuropneumoniae* | 46 | NR_074857 | clade_88 | N | N |
| *Actinobacillus ureae* | 48 | AEVG01000167 | clade_88 | N | N |
| *Haemophilus aegyptius* | 969 | AFBC01000053 | clade_88 | N | N |
| *Haemophilus ducreyi* | 970 | AE017143 | clade_88 | N | OP |
| *Haemophilus haemolyticus* | 973 | JN175335 | clade_88 | N | N |
| *Haemophilus influenzae* | 974 | AADP01000001 | clade_88 | N | OP |
| *Haemophilus parahaemolyticus* | 975 | GU561425 | clade_88 | N | N |
| *Haemophilus parainfluenzae* | 976 | AEWU01000024 | clade_88 | N | N |
| *Haemophilus paraphrophaemolyticus* | 977 | M75076 | clade_88 | N | N |
| *Haemophilus somnus* | 979 | NC_008309 | clade_88 | N | N |
| *Haemophilus* sp. 70334 | 980 | HQ680854 | clade_88 | N | N |
| *Haemophilus* sp. HK445 | 981 | FJ685624 | clade_88 | N | N |
| *Haemophilus* sp. oral clone ASCA07 | 982 | AY923117 | clade_88 | N | N |
| *Haemophilus* sp. oral clone ASCG06 | 983 | AY923147 | clade_88 | N | N |
| *Haemophilus* sp. oral clone BJ021 | 984 | AY005034 | clade_88 | N | N |
| *Haemophilus* sp. oral clone BJ095 | 985 | AY005033 | clade_88 | N | N |
| *Haemophilus* sp. oral taxon 851 | 987 | AGRK01000004 | clade_88 | N | N |
| *Haemophilus sputorum* | 988 | AFNK01000005 | clade_88 | N | N |
| *Histophilus somni* | 1003 | AF549387 | clade_88 | N | N |
| *Mannheimia haemolytica* | 1195 | ACZX01000102 | clade_88 | N | N |
| *Pasteurella bettyae* | 1433 | L06088 | clade_88 | N | N |
| *Moellerella wisconsensis* | 1253 | JN175344 | clade_89 | N | N |
| *Morganella morganii* | 1265 | AJ301681 | clade_89 | N | N |
| *Morganella* sp. JB_T16 | 1266 | AJ781005 | clade_89 | N | N |
| *Proteus mirabilis* | 1582 | ACLE01000013 | clade_89 | N | N |
| *Proteus penneri* | 1583 | ABVP01000020 | clade_89 | N | N |
| *Proteus* sp. HS7514 | 1584 | DQ512963 | clade_89 | N | N |
| *Proteus vulgaris* | 1585 | AJ233425 | clade_89 | N | N |
| *Eubacterium* sp. oral clone JN088 | 869 | AY349377 | clade_90 | Y | N |
| *Oribacterium sinus* | 1374 | ACKX01000142 | clade_90 | N | N |
| *Oribacterium* sp. ACB1 | 1375 | HM120210 | clade_90 | N | N |
| *Oribacterium* sp. ACB7 | 1376 | HM120211 | clade_90 | N | N |
| *Oribacterium* sp. CM12 | 1377 | HQ616374 | clade_90 | N | N |
| *Oribacterium* sp. ICM51 | 1378 | HQ616397 | clade_90 | N | N |
| *Oribacterium* sp. OBRC12 | 1379 | HQ616355 | clade_90 | N | N |
| *Oribacterium* sp. oral taxon 108 | 1382 | AFIH01000001 | clade_90 | N | N |
| *Actinobacillus actinomycetemcomitans* | 44 | AY362885 | clade_92 | N | N |
| *Actinobacillus succinogenes* | 47 | CP000746 | clade_92 | N | N |
| *Aggregatibacter actinomycetemcomitans* | 112 | CP001733 | clade_92 | N | N |
| *Aggregatibacter aphrophilus* | 113 | CP001607 | clade_92 | N | N |
| *Aggregatibacter segnis* | 114 | AEPS01000017 | clade_92 | N | N |
| *Averyella dalhousiensis* | 194 | DQ481464 | clade_92 | N | N |
| Bisgaard Taxon | 368 | AY683487 | clade_92 | N | N |
| Bisgaard Taxon | 369 | AY683489 | clade_92 | N | N |
| Bisgaard Taxon | 370 | AY683491 | clade_92 | N | N |
| Bisgaard Taxon | 371 | AY683492 | clade_92 | N | N |
| *Buchnera aphidicola* | 440 | NR_074609 | clade_92 | N | N |
| *Cedecea davisae* | 499 | AF493976 | clade_92 | N | N |
| *Citrobacter amalonaticus* | 517 | FR870441 | clade_92 | N | N |
| *Citrobacter braakii* | 518 | NR_028687 | clade_92 | N | N |
| *Citrobacter farmeri* | 519 | AF025371 | clade_92 | N | N |
| *Citrobacter freundii* | 520 | NR_028894 | clade_92 | N | N |
| *Citrobacter gillenii* | 521 | AF025367 | clade_92 | N | N |
| *Citrobacter koseri* | 522 | NC_009792 | clade_92 | N | N |
| *Citrobacter murliniae* | 523 | AF025369 | clade_92 | N | N |
| *Citrobacter rodentium* | 524 | NR_074903 | clade_92 | N | N |
| *Citrobacter sedlakii* | 525 | AF025364 | clade_92 | N | N |
| *Citrobacter* sp. 30_2 | 526 | ACDJ01000053 | clade_92 | N | N |
| *Citrobacter* sp. KMSI_3 | 527 | GQ468398 | clade_92 | N | N |
| *Citrobacter werkmanii* | 528 | AF025373 | clade_92 | N | N |

TABLE 1-continued

| OTU | SEQ ID Number | Public DB Accession | Phylogenetic Clade | Spore Former | Pathogen Status |
| --- | --- | --- | --- | --- | --- |
| *Citrobacter youngae* | 529 | ABWL02000011 | clade_92 | N | N |
| *Cronobacter malonaticus* | 737 | GU122174 | clade_92 | N | N |
| *Cronobacter sakazakii* | 738 | NC_009778 | clade_92 | N | N |
| *Cronobacter turicensis* | 739 | FN543093 | clade_92 | N | N |
| *Enterobacter aerogenes* | 786 | AJ251468 | clade_92 | N | N |
| *Enterobacter asburiae* | 787 | NR_024640 | clade_92 | N | N |
| *Enterobacter cancerogenus* | 788 | Z96078 | clade_92 | N | N |
| *Enterobacter cloacae* | 789 | FP929040 | clade_92 | N | N |
| *Enterobacter cowanii* | 790 | NR_025566 | clade_92 | N | N |
| *Enterobacter hormaechei* | 791 | AFHR01000079 | clade_92 | N | N |
| *Enterobacter* sp. 247BMC | 792 | HQ122932 | clade_92 | N | N |
| *Enterobacter* sp. 638 | 793 | NR_074777 | clade_92 | N | N |
| *Enterobacter* sp. JC163 | 794 | JN657217 | clade_92 | N | N |
| *Enterobacter* sp. SCSS | 795 | HM007811 | clade_92 | N | N |
| *Enterobacter* sp. TSE38 | 796 | HM156134 | clade_92 | N | N |
| Enterobacteriaceae bacterium 9_2_54FAA | 797 | ADCU01000033 | clade_92 | N | N |
| Enterobacteriaceae bacterium CF01Ent_1 | 798 | AJ489826 | clade_92 | N | N |
| Enterobacteriaceae bacterium Smarlab 3302238 | 799 | AY538694 | clade_92 | N | N |
| *Escherichia albertii* | 824 | ABKX01000012 | clade_92 | N | N |
| *Escherichia coli* | 825 | NC_008563 | clade_92 | N | Category-B |
| *Escherichia fergusonii* | 826 | CU928158 | clade_92 | N | N |
| *Escherichia hermannii* | 827 | HQ407266 | clade_92 | N | N |
| *Escherichia* sp. 1_1_43 | 828 | ACID01000033 | clade_92 | N | N |
| *Escherichia* sp. 4_1_40B | 829 | ACDM02000056 | clade_92 | N | N |
| *Escherichia* sp. B4 | 830 | EU722735 | clade_92 | N | N |
| *Escherichia vulneris* | 831 | NR_041927 | clade_92 | N | N |
| *Ewingella americana* | 877 | JN175329 | clade_92 | N | N |
| *Haemophilus* genomosp. P2 oral clone MB3_C24 | 971 | DQ003621 | clade_92 | N | N |
| *Haemophilus* genomosp. P3 oral clone MB3_C38 | 972 | DQ003635 | clade_92 | N | N |
| *Haemophilus* sp. oral clone JM053 | 986 | AY349380 | clade_92 | N | N |
| *Hafnia alvei* | 989 | DQ412565 | clade_92 | N | N |
| *Klebsiella oxytoca* | 1024 | AY292871 | clade_92 | N | OP |
| *Klebsiella pneumoniae* | 1025 | CP000647 | clade_92 | N | OP |
| *Klebsiella* sp. AS10 | 1026 | HQ616362 | clade_92 | N | N |
| *Klebsiella* sp. Co9935 | 1027 | DQ068764 | clade_92 | N | N |
| *Klebsiella* sp. enrichment culture clone SRC_DSD25 | 1036 | HM195210 | clade_92 | N | N |
| *Klebsiella* sp. OBRC7 | 1028 | HQ616353 | clade_92 | N | N |
| *Klebsiella* sp. SP_BA | 1029 | FJ999767 | clade_92 | N | N |
| *Klebsiella* sp. SRC_DSD1 | 1033 | GU797254 | clade_92 | N | N |
| *Klebsiella* sp. SRC_DSD11 | 1030 | GU797263 | clade_92 | N | N |
| *Klebsiella* sp. SRC_DSD12 | 1031 | GU797264 | clade_92 | N | N |
| *Klebsiella* sp. SRC_DSD15 | 1032 | GU797267 | clade_92 | N | N |
| *Klebsiella* sp. SRC_DSD2 | 1034 | GU797253 | clade_92 | N | N |
| *Klebsiella* sp. SRC_DSD6 | 1035 | GU797258 | clade_92 | N | N |
| *Klebsiella variicola* | 1037 | CP001891 | clade_92 | N | N |
| *Kluyvera ascorbata* | 1038 | NR_028677 | clade_92 | N | N |
| *Kluyvera cryocrescens* | 1039 | NR_028803 | clade_92 | N | N |
| *Leminorella grimontii* | 1159 | AJ233421 | clade_92 | N | N |
| *Leminorella richardii* | 1160 | HF558368 | clade_92 | N | N |
| *Pantoea agglomerans* | 1409 | AY335552 | clade_92 | N | N |
| *Pantoea ananatis* | 1410 | CP001875 | clade_92 | N | N |
| *Pantoea brenneri* | 1411 | EU216735 | clade_92 | N | N |
| *Pantoea citrea* | 1412 | EF688008 | clade_92 | N | N |
| *Pantoea conspicua* | 1413 | EU216737 | clade_92 | N | N |
| *Pantoea septica* | 1414 | EU216734 | clade_92 | N | N |
| *Pasteurella dagmatis* | 1434 | ACZR01000003 | clade_92 | N | N |
| *Pasteurella multocida* | 1435 | NC_002663 | clade_92 | N | N |
| *Plesiomonas shigelloides* | 1469 | X60418 | clade_92 | N | N |
| *Raoultella ornithinolytica* | 1617 | AB364958 | clade_92 | N | N |
| *Raoultella planticola* | 1618 | AF129443 | clade_92 | N | N |
| *Raoultella terrigena* | 1619 | NR_037085 | clade_92 | N | N |
| *Salmonella bongori* | 1683 | NR_041699 | clade_92 | N | Category-B |
| *Salmonella enterica* | 1672 | NC_011149 | clade_92 | N | Category-B |
| *Salmonella enterica* | 1673 | NC_011205 | clade_92 | N | Category-B |
| *Salmonella enterica* | 1674 | DQ344532 | clade_92 | N | Category-B |
| *Salmonella enterica* | 1675 | ABEH02000004 | clade_92 | N | Category-B |
| *Salmonella enterica* | 1676 | ABAK02000001 | clade_92 | N | Category-B |
| *Salmonella enterica* | 1677 | NC_011080 | clade_92 | N | Category-B |
| *Salmonella enterica* | 1678 | EU118094 | clade_92 | N | Category-B |
| *Salmonella enterica* | 1679 | NC_011094 | clade_92 | N | Category-B |
| *Salmonella enterica* | 1680 | AE014613 | clade_92 | N | Category-B |
| *Salmonella enterica* | 1682 | ABFH02000001 | clade_92 | N | Category-B |
| *Salmonella enterica* | 1684 | ABEM01000001 | clade_92 | N | Category-B |

TABLE 1-continued

| OTU | SEQ ID Number | Public DB Accession | Phylogenetic Clade | Spore Former | Pathogen Status |
|---|---|---|---|---|---|
| Salmonella enterica | 1685 | ABAM02000001 | clade_92 | N | Category-B |
| Salmonella typhimurium | 1681 | DQ344533 | clade_92 | N | Category-B |
| Salmonella typhimurium | 1686 | AF170176 | clade_92 | N | Category-B |
| Serratia fonticola | 1718 | NR_025339 | clade_92 | N | N |
| Serratia liquefaciens | 1719 | NR_042062 | clade_92 | N | N |
| Serratia marcescens | 1720 | GU826157 | clade_92 | N | N |
| Serratia odorifera | 1721 | ADBY01000001 | clade_92 | N | N |
| Serratia proteamaculans | 1722 | AAUN01000015 | clade_92 | N | N |
| Shigella boydii | 1724 | AAKA01000007 | clade_92 | N | Category-B |
| Shigella dysenteriae | 1725 | NC_007606 | clade_92 | N | Category-B |
| Shigella flexneri | 1726 | AE005674 | clade_92 | N | Category-B |
| Shigella sonnei | 1727 | NC_007384 | clade_92 | N | Category-B |
| Tatumella ptyseos | 1916 | NR_025342 | clade_92 | N | N |
| Trabulsiella guamensis | 1925 | AY373830 | clade_92 | N | N |
| Yersinia aldovae | 2019 | AJ871363 | clade_92 | N | OP |
| Yersinia aleksiciae | 2020 | AJ627597 | clade_92 | N | OP |
| Yersinia bercovieri | 2021 | AF366377 | clade_92 | N | OP |
| Yersinia enterocolitica | 2022 | FR729477 | clade_92 | N | Category-B |
| Yersinia frederiksenii | 2023 | AF366379 | clade_92 | N | OP |
| Yersinia intermedia | 2024 | AF366380 | clade_92 | N | OP |
| Yersinia kristensenii | 2025 | ACCA01000078 | clade_92 | N | OP |
| Yersinia mollaretii | 2026 | NR_027546 | clade_92 | N | OP |
| Yersinia pestis | 2027 | AE013632 | clade_92 | N | Category-A |
| Yersinia pseudotuberculosis | 2028 | NC_009708 | clade_92 | N | OP |
| Yersinia rohdei | 2029 | ACCD01000071 | clade_92 | N | OP |
| Yokenella regensburgei | 2030 | AB273739 | clade_92 | N | N |
| Conchiformibius kuhniae | 669 | NR_041821 | clade_94 | N | N |
| Morococcus cerebrosus | 1267 | JN175352 | clade_94 | N | N |
| Neisseria bacilliformis | 1328 | AFAY01000058 | clade_94 | N | N |
| Neisseria cinerea | 1329 | ACDY01000037 | clade_94 | N | N |
| Neisseria flavescens | 1331 | ACQV01000025 | clade_94 | N | N |
| Neisseria gonorrhoeae | 1333 | CP002440 | clade_94 | N | OP |
| Neisseria lactamica | 1334 | ACEQ01000095 | clade_94 | N | N |
| Neisseria macacae | 1335 | AFQE01000146 | clade_94 | N | N |
| Neisseria meningitidis | 1336 | NC_003112 | clade_94 | N | OP |
| Neisseria mucosa | 1337 | ACDX01000110 | clade_94 | N | N |
| Neisseria pharyngis | 1338 | AJ239281 | clade_94 | N | N |
| Neisseria polysaccharea | 1339 | ADBE01000137 | clade_94 | N | N |
| Neisseria sicca | 1340 | ACKO02000016 | clade_94 | N | N |
| Neisseria sp. KEM232 | 1341 | GQ203291 | clade_94 | N | N |
| Neisseria sp. oral clone AP132 | 1344 | AY005027 | clade_94 | N | N |
| Neisseria sp. oral strain B33KA | 1346 | AY005028 | clade_94 | N | N |
| Neisseria sp. oral taxon 014 | 1347 | ADEA01000039 | clade_94 | N | N |
| Neisseria sp. TM10_1 | 1343 | DQ279352 | clade_94 | N | N |
| Neisseria subflava | 1348 | ACEO01000067 | clade_94 | N | N |
| Clostridium oroticum | 610 | FR749922 | clade_96 | Y | N |
| Clostridium sp. D5 | 627 | ADBG01000142 | clade_96 | Y | N |
| Eubacterium contortum | 840 | FR749946 | clade_96 | Y | N |
| Eubacterium fissicatena | 846 | FR749935 | clade_96 | Y | N |
| Okadaella gastrococcus | 1365 | HQ699465 | clade_98 | N | N |
| Streptococcus agalactiae | 1785 | AAJO01000130 | clade_98 | N | N |
| Streptococcus alactolyticus | 1786 | NR_041781 | clade_98 | N | N |
| Streptococcus australis | 1788 | AEQR01000024 | clade_98 | N | N |
| Streptococcus bovis | 1789 | AEEL01000030 | clade_98 | N | N |
| Streptococcus canis | 1790 | AJ413203 | clade_98 | N | N |
| Streptococcus constellatus | 1791 | AY277942 | clade_98 | N | N |
| Streptococcus cristatus | 1792 | AEVC01000028 | clade_98 | N | N |
| Streptococcus dysgalactiae | 1794 | AP010935 | clade_98 | N | N |
| Streptococcus equi | 1795 | CP001129 | clade_98 | N | N |
| Streptococcus equinus | 1796 | AEVB01000043 | clade_98 | N | N |
| Streptococcus gallolyticus | 1797 | FR824043 | clade_98 | N | N |
| Streptococcus genomosp. C1 | 1798 | AY278629 | clade_98 | N | N |
| Streptococcus genomosp. C2 | 1799 | AY278630 | clade_98 | N | N |
| Streptococcus genomosp. C3 | 1800 | AY278631 | clade_98 | N | N |
| Streptococcus genomosp. C4 | 1801 | AY278632 | clade_98 | N | N |
| Streptococcus genomosp. C5 | 1802 | AY278633 | clade_98 | N | N |
| Streptococcus genomosp. C6 | 1803 | AY278634 | clade_98 | N | N |
| Streptococcus genomosp. C7 | 1804 | AY278635 | clade_98 | N | N |
| Streptococcus genomosp. C8 | 1805 | AY278609 | clade_98 | N | N |
| Streptococcus gordonii | 1806 | NC_009785 | clade_98 | N | N |
| Streptococcus infantarius | 1807 | ABJK02000017 | clade_98 | N | N |
| Streptococcus infantis | 1808 | AFNN01000024 | clade_98 | N | N |
| Streptococcus intermedius | 1809 | NR_028736 | clade_98 | N | N |
| Streptococcus lutetiensis | 1810 | NR_037096 | clade_98 | N | N |
| Streptococcus massiliensis | 1811 | AY769997 | clade_98 | N | N |
| Streptococcus mitis | 1813 | AM157420 | clade_98 | N | N |
| Streptococcus oligofermentans | 1815 | AY099095 | clade_98 | N | N |

TABLE 1-continued

| OTU | SEQ ID Number | Public DB Accession | Phylogenetic Clade | Spore Former | Pathogen Status |
|---|---|---|---|---|---|
| *Streptococcus oralis* | 1816 | ADMV01000001 | clade_98 | N | N |
| *Streptococcus parasanguinis* | 1817 | AEKM01000012 | clade_98 | N | N |
| *Streptococcus pasteurianus* | 1818 | AP012054 | clade_98 | N | N |
| *Streptococcus peroris* | 1819 | AEVF01000016 | clade_98 | N | N |
| *Streptococcus pneumoniae* | 1820 | AE008537 | clade_98 | N | N |
| *Streptococcus porcinus* | 1821 | EF121439 | clade_98 | N | N |
| *Streptococcus pseudopneumoniae* | 1822 | FJ827123 | clade_98 | N | N |
| *Streptococcus pseudoporcinus* | 1823 | AENS01000003 | clade_98 | N | N |
| *Streptococcus pyogenes* | 1824 | AE006496 | clade_98 | N | OP |
| *Streptococcus ratti* | 1825 | X58304 | clade_98 | N | N |
| *Streptococcus salivarius* | 1826 | AGBV01000001 | clade_98 | N | N |
| *Streptococcus sanguinis* | 1827 | NR_074974 | clade_98 | N | N |
| *Streptococcus sinensis* | 1828 | AF432857 | clade_98 | N | N |
| *Streptococcus* sp. 2_1_36FAA | 1831 | ACOI01000028 | clade_98 | N | N |
| *Streptococcus* sp. 2285_97 | 1830 | AJ131965 | clade_98 | N | N |
| *Streptococcus* sp. ACS2 | 1834 | HQ616360 | clade_98 | N | N |
| *Streptococcus* sp. AS20 | 1835 | HQ616366 | clade_98 | N | N |
| *Streptococcus* sp. BS35a | 1836 | HQ616369 | clade_98 | N | N |
| *Streptococcus* sp. C150 | 1837 | ACRI01000045 | clade_98 | N | N |
| *Streptococcus* sp. CM6 | 1838 | HQ616372 | clade_98 | N | N |
| *Streptococcus* sp. ICM10 | 1840 | HQ616389 | clade_98 | N | N |
| *Streptococcus* sp. ICM12 | 1841 | HQ616390 | clade_98 | N | N |
| *Streptococcus* sp. ICM2 | 1842 | HQ616386 | clade_98 | N | N |
| *Streptococcus* sp. ICM4 | 1844 | HQ616387 | clade_98 | N | N |
| *Streptococcus* sp. ICM45 | 1843 | HQ616394 | clade_98 | N | N |
| *Streptococcus* sp. M143 | 1845 | ACRK01000025 | clade_98 | N | N |
| *Streptococcus* sp. M334 | 1846 | ACRL01000052 | clade_98 | N | N |
| *Streptococcus* sp. oral clone ASB02 | 1849 | AY923121 | clade_98 | N | N |
| *Streptococcus* sp. oral clone ASCA03 | 1850 | DQ272504 | clade_98 | N | N |
| *Streptococcus* sp. oral clone ASCA04 | 1851 | AY923116 | clade_98 | N | N |
| *Streptococcus* sp. oral clone ASCA09 | 1852 | AY923119 | clade_98 | N | N |
| *Streptococcus* sp. oral clone ASCB04 | 1853 | AY923123 | clade_98 | N | N |
| *Streptococcus* sp. oral clone ASCB06 | 1854 | AY923124 | clade_98 | N | N |
| *Streptococcus* sp. oral clone ASCC04 | 1855 | AY923127 | clade_98 | N | N |
| *Streptococcus* sp. oral clone ASCC05 | 1856 | AY923128 | clade_98 | N | N |
| *Streptococcus* sp. oral clone ASCC12 | 1857 | DQ272507 | clade_98 | N | N |
| *Streptococcus* sp. oral clone ASCD01 | 1858 | AY923129 | clade_98 | N | N |
| *Streptococcus* sp. oral clone ASCD09 | 1859 | AY923130 | clade_98 | N | N |
| *Streptococcus* sp. oral clone ASCD10 | 1860 | DQ272509 | clade_98 | N | N |
| *Streptococcus* sp. oral clone ASCE03 | 1861 | AY923134 | clade_98 | N | N |
| *Streptococcus* sp. oral clone ASCE04 | 1862 | AY953253 | clade_98 | N | N |
| *Streptococcus* sp. oral clone ASCE05 | 1863 | DQ272510 | clade_98 | N | N |
| *Streptococcus* sp. oral clone ASCE06 | 1864 | AY923135 | clade_98 | N | N |
| *Streptococcus* sp. oral clone ASCE09 | 1865 | AY923136 | clade_98 | N | N |
| *Streptococcus* sp. oral clone ASCE10 | 1866 | AY923137 | clade_98 | N | N |
| *Streptococcus* sp. oral clone ASCE12 | 1867 | AY923138 | clade_98 | N | N |
| *Streptococcus* sp. oral clone ASCF05 | 1868 | AY923140 | clade_98 | N | N |
| *Streptococcus* sp. oral clone ASCF07 | 1869 | AY953255 | clade_98 | N | N |
| *Streptococcus* sp. oral clone ASCF09 | 1870 | AY923142 | clade_98 | N | N |
| *Streptococcus* sp. oral clone ASCG04 | 1871 | AY923145 | clade_98 | N | N |
| *Streptococcus* sp. oral clone BW009 | 1872 | AY005042 | clade_98 | N | N |
| *Streptococcus* sp. oral clone CH016 | 1873 | AY005044 | clade_98 | N | N |
| *Streptococcus* sp. oral clone GK051 | 1874 | AY349413 | clade_98 | N | N |
| *Streptococcus* sp. oral clone GM006 | 1875 | AY349414 | clade_98 | N | N |
| *Streptococcus* sp. oral clone P2PA_41 P2 | 1876 | AY207051 | clade_98 | N | N |
| *Streptococcus* sp. oral clone P4PA_30 P4 | 1877 | AY207064 | clade_98 | N | N |
| *Streptococcus* sp. oral taxon 071 | 1878 | AEEP01000019 | clade_98 | N | N |
| *Streptococcus* sp. oral taxon G59 | 1879 | GU432132 | clade_98 | N | N |
| *Streptococcus* sp. oral taxon G62 | 1880 | GU432146 | clade_98 | N | N |
| *Streptococcus* sp. oral taxon G63 | 1881 | GU432150 | clade_98 | N | N |
| *Streptococcus suis* | 1882 | FM252032 | clade_98 | N | N |
| *Streptococcus thermophilus* | 1883 | CP000419 | clade_98 | N | N |
| *Streptococcus uberis* | 1884 | HQ391900 | clade_98 | N | N |
| *Streptococcus urinalis* | 1885 | DQ303194 | clade_98 | N | N |
| *Streptococcus vestibularis* | 1886 | AEKO01000008 | clade_98 | N | N |
| *Streptococcus viridans* | 1887 | AF076036 | clade_98 | N | N |
| *Synergistetes bacterium* oral clone 03 5 D05 | 1908 | GU227192 | clade_98 | N | N |

TABLE 2

| Phylogenetic Clade | OTUs in clade |
|---|---|
| clade_172 | Bifidobacteriaceae genomosp. C1, *Bifidobacterium adolescentis, Bifidobacterium angulatum, Bifidobacterium animalis, Bifidobacterium breve, Bifidobacterium catenulatum, Bifidobacterium dentium, Bifidobacterium gallicuin, Bifidobacterium infantis, Bifidobacterium kashiwanohense, Bifidobacterium longum, Bifidobacterium pseudocatenulatum, Bifidobacterium pseudolongum, Bifidobacterium scardovii, Bifidobacterium* sp. HM2, *Bifidobacterium* sp. HMLN12, *Bifidobacterium* sp. M45, *Bifidobacterium* sp. MSX5B, *Bifidobacterium* sp. TM_7, *Bifidobacterium thermophilum* |
| clade_172i | Bifidobacteriaceae genomosp. C1, *Bifidobacterium angulatum, Bifidobacterium animalis, Bifidobacterium breve, Bifidobacterium catenulatum, Bifidobacterium dentium, Bifidobacterium gallicum, Bifidobacterium infantis, Bifidobacterium kashiwanohense, Bifidobacterium pseudocatenulatum, Bifidobacterium pseudolongum, Bifidobacterium scardovii, Bifidobacterium* sp. HM2, *Bifidobacterium* sp. HMLN12, *Bifidobacterium* sp. M45, *Bifidobacterium* sp. MSX5B, *Bifidobacterium* sp. TM 7, *Bifidobacterium thermophilum* |
| clade_198 | *Lactobacillus casei, Lactobacillus paracasei, Lactobacillus zeae* |
| clade_198i | *Lactobacillus zeae* |
| clade_260 | *Clostridium hylemonae, Clostridium scindens,* Lachnospiraceae bacterium 5_1_57FAA |
| clade_260c | *Clostridium hylemonae,* Lachnospiraceae bacterium 5_1_57FAA |
| clade_260g | *Clostridium hylemonae,* Lachnospiraceae bacterium 5_1_57FAA |
| clade_260h | *Clostridium hylemonae,* Lachnospiraceae bacterium 5_1_57FAA |
| clade_262 | *Clostridium glycyrrhizinilyticum, Clostridium nexile, Coprococcus comes,* Lachnospiraceae bacterium 1_1_57FAA, Lachnospiraceae bacterium 1_4_56FAA, Lachnospiraceae bacterium 8_1_57FAA, *Ruminococcus lactaris, Rummococcus torques* |
| clade_262i | *Clostridium glycyrrhizinilyticum, Clostridium nexile, Coprococcus comes,* Lachnospiraceae bacterium 1_1_57FAA, Lachnospiraceae bacterium 1_4_56FAA, Lachnospiraceae bacterium 8_1_57FAA, *Ruminococcus lactaris* |
| clade_309 | *Blautia coccoides, Blautia glucerasea, Blautia glucerasei, Blautia hansenii, Blautia luti, Blautia producta, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus obeum, Ruminococcus* sp. 5_1_39BFAA, *Ruminococcus* sp. K_1, *Syntrophococcus sucromutans* |
| clade_309e | *Blautia coccoides, Blautia glucerasea, Blautia glucerasei, Blautia hansenii, Blautia luti, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus obeum, Ruminococcus* sp. 5_1_39BFAA, *Ruminococcus* sp. K_1, *Syntrophococcus sucromutans* |
| clade_309e | *Blautia coccoides, Blautia glucerasea, Blautia glucerasei, Blautia hansenii, Blautia luti, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus obeum, Ruminococcus* sp. 5_1_39BFAA, *Ruminococcus* sp. K_1, *Syntrophococcus sucromutans* |
| clade_309g | *Blautia coccoides, Blautia glucerasea, Blautia glucerasei, Blautia hansenii, Blautia luti, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus obeum, Ruminococcus* sp. 5_1_39BFAA, *Ruminococcus* sp. K_1, *Syntrophococcus sucromutans* |
| clade_309h | *Blautia coccoides, Blautia glucerasea, Blautia glucerasei, Blautia hansenii, Blautia luti, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus obeum, Ruminococcus* sp. 5_1_39BFAA, *Ruminococcus* sp. K_1, *Syntrophococcus sucromutans* |
| clade_309i | *Blautia coccoides, Blautia glucerasea, Blautia glucerasei, Blautia hansenii, Blautia luti, Blautia schinkii, Blautia* sp. M25, *Blautia stercoris, Blautia wexlerae, Bryantella formatexigens, Clostridium coccoides, Eubacterium cellulosolvens,* Lachnospiraceae bacterium 6_1_63FAA, *Marvinbryantia formatexigens, Ruminococcus hansenii, Ruminococcus* sp. 5_1_39BFAA, *Ruminococcus* sp. K_1, *Syntrophococcus sucromutans* |
| clade_313 | *Lactobacillus antri, Lactobacillus coleohominis, Lactobacillus fermentum, Lactobacillus gastricus, Lactobacillus mucosae, Lactobacillus oris, Lactobacillus pontis, Lactobacillus reuteri, Lactobacillus* sp. KLDS 1.0707, *Lactobacillus* sp. KLDS 1.0709, *Lactobacillus* sp. KLDS 1.0711, *Lactobacillus* sp. KLDS 1.0713, *Lactobacillus* sp. KLDS 1.0716, *Lactobacillus* sp. KLDS 1.0718, *Lactobacillus* sp. oral taxon 052, *Lactobacillus vaginalis* |
| clade_313f | *Lactobacillus antri, Lactobacillus coleohominis, Lactobacillus fermentum, Lactobacillus gastricus, Lactobacillus mucosae, Lactobacillus oris, Lactobacillus pontis, Lactobacillus* sp. KLDS 1.0707, *Lactobacillus* sp. KLDS 1.0709, *Lactobacillus* sp. KLDS 1.0711, *Lactobacillus* sp. KLDS 1.0713, *Lactobacillus* sp. KLDS 1.0716, *Lactobacillus* sp. KLDS 1.0718, *Lactobacillus* sp. oral taxon 052, *Lactobacillus vaginalis* |
| clade_325 | *Staphylococcus aureus, Staphylococcus auricularis, Staphylococcus capitis, Staphylococcus caprae, Staphylococcus carnosus, Staphylococcus cohnii, Staphylococcus condimenti, Staphylococcus epidermidis, Staphylococcus equorum, Staphylococcus haemolyticus, Staphylococcus hominis, Staphylococcus lugdunensis, Staphylococcus pasteuri, Staphylococcus pseudintermedius, Staphylococcus saccharolyticus, Staphylococcus saprophyticus, Staphylococcus* sp. H292, *Staphylococcus* sp. H780, *Staphylococcus* sp. clone bottae7, *Staphylococcus succinus, Staphylococcus warneri, Staphylococcus xylosus* |
| clade_325f | *Staphylococcus aureus, Staphylococcus auricularis, Staphylococcus capitis, Staphylococcus caprae, Staphylococcus carnosus, Staphylococcus cohnii, Staphylococcus condimenti, Staphylococcus epidermidis, Staphylococcus equorum, Staphylococcus haemolyticus, Staphylococcus hominis, Staphylococcus lugdunensis, Staphylococcus pseudintermedius, Staphylococcus saccharolyticus, Staphylococcus saprophyticus, Staphylococcus* sp. H292, *Staphylococcus* sp. H780, *Staphylococcus* sp. clone bottae7, *Staphylococcus succinus, Staphylococcus xylosus* |

TABLE 2-continued

| Phylogenetic Clade | OTUs in clade |
|---|---|
| clade_335 | *Bacteroides* sp. 20_3, *Bacteroides* sp. 3_1_19, *Bacteroides* sp. 3_2_5, *Parabacteroides distasonis*, *Parabacteroides goldsteinii*, *Parabacteroides gordonii*, *Parabacteroides* sp. D13 |
| clade_335i | *Bacteroides* sp. 20_3, *Bacteroides* sp. 3_1_19, *Bacteroides* sp. 3_2_5, *Parabacteroides goldsteinii*, *Parabacteroides gordonii*, *Parabacteroides* sp. D13 |
| clade_351 | *Clostridium innocuum*, *Clostridium* sp. HGF2 |
| clade_351e | *Clostridium* sp. HGF2 |
| clade_354 | *Clostridium bartlettii*, *Clostridium bifermentans*, *Clostridium ghonii*, *Clostridium glycolicum*, *Clostridium mayombei*, *Clostridium sordellii*, *Clostridium* sp. MT4 E, *Eubacterium tenue* |
| clade_354e | *Clostridium bartlettii*, *Clostridium ghonii*, *Clostridium glycolicum*, *Clostridium mayombei*, *Clostridium sordellii*, *Clostridium* sp. MT4 E, *Eubacterium tenue* |
| clade_360 | *Dorea formicigenerans*, *Dorea longicatena*, Lachnospiraceae bacterium 2_1_46FAA, Lachnospiraceae bacterium 2_1_58FAA, Lachnospiraceae bacterium 4_1_37FAA, Lachnospiraceae bacterium 9_1_43BFAA, *Ruminococcus gnavus*, *Ruminococcus* sp. ID8 |
| clade_360c | *Dorea formicigenerans*, *Dorea longicatena*, Lachnospiraceae bacterium 2_1_46FAA, Lachnospiraceae bacterium 2_1_58FAA, Lachnospiraceae bacterium 4_1_37FAA, Lachnospiraceae bacterium 9_1_43BFAA, *Ruminococcus gnavus* |
| clade_360g | *Dorea formicigenerans*, *Dorea longicatena*, Lachnospiraceae bacterium 2_1_46FAA, Lachnospiraceae bacterium 2_1_58FAA, Lachnospiraceae bacterium 4_1_37FAA, Lachnospiraceae bacterium 9_1_43BFAA, *Ruminococcus gnavus* |
| clade_360h | *Dorea formicigenerans*, *Dorea longicatena*, Lachnospiraceae bacterium 2_1_46FAA, Lachnospiraceae bacterium 2_1_58FAA, Lachnospiraceae bacterium 4_1_37FAA, Lachnospiraceae bacterium 9_1_43BFAA, *Ruminococcus gnavus* |
| clade_360i | *Dorea formicigenerans*, Lachnospiraceae bacterium 2_1_46FAA, Lachnospiraceae bacterium 2_1_58FAA, Lachnospiraceae bacterium 4_1_37FAA, Lachnospiraceae bacterium 9_1_43BFAA, *Ruminococcus gnavus*, *Ruminococcus* sp. ID8 |
| clade_378 | *Bacteroides barnesiae*, *Bacteroides coprocola*, *Bacteroides coprophilus*, *Bacteroides dorei*, *Bacteroides massiliensis*, *Bacteroides plebeius*, *Bacteroides* sp. 3_1_33FAA, *Bacteroides* sp. 3_1_40A, *Bacteroides* sp. 4_3_47FAA, *Bacteroides* sp. 9_1_42FAA, *Bacteroides* sp. NB_8, *Bacteroides vulgatus* |
| clade_378e | *Bacteroides barnesiae*, *Bacteroides coprocola*, *Bacteroides coprophilus*, *Bacteroides dorei*, *Bacteroides massiliensis*, *Bacteroides plebeius*, *Bacteroides* sp. 3_1_33FAA, *Bacteroides* sp. 3_1_40A, *Bacteroides* sp. 4_3_47FAA, *Bacteroides* sp. 9_1_42FAA, *Bacteroides* sp. NB_8 |
| clade_38 | *Bacteroides ovatus*, *Bacteroides* sp. 1_1_30, *Bacteroides* sp. 2_1_22, *Bacteroides* sp. 2_2_4, *Bacteroides* sp. 3_1_23, *Bacteroides* sp. D1, *Bacteroides* sp. D2, *Bacteroides* sp. D22, *Bacteroides xylanisolvens* |
| clade_38e | *Bacteroides* sp. 1_1_30, *Bacteroides* sp. 2_1_22, *Bacteroides* sp. 2_2_4, *Bacteroides* sp. 3_1_23, *Bacteroides* sp. D1, *Bacteroides* sp. D2, *Bacteroides* sp. D22, *Bacteroides xylanisolvens* |
| clade_38i | *Bacteroides* sp. 1_1_30, *Bacteroides* sp. 2_1_22, *Bacteroides* sp. 2_2_4, *Bacteroides* sp. 3_1_23, *Bacteroides* sp. D1, *Bacteroides* sp. D2, *Bacteroides* sp. D22, *Bacteroides xylanisolvens* |
| clade_408 | *Anaerostipes caccae*, *Anaerostipes* sp. 3_2_56FAA, Clostridiales bacterium 1_7_47FAA, Clostridiales sp. SM4_1, Clostridiales sp. SSC_2, *Clostridium aerotolerans*, *Clostridium aldenense*, *Clostridium algidixylanolyticum*, *Clostridium amygdalinum*, *Clostridium asparagiforme*, *Clostridium bolteae*, *Clostridium celerecrescens*, *Clostridium citroniae*, *Clostridium clostridiiformes*, *Clostridium clostridioforme*, *Clostridium hathewayi*, *Clostridium indolis*, *Clostridium lavalense*, *Clostridium saccharolyticum*, *Clostridium* sp. M62_1, *Clostridium* sp. SS2_1, *Clostridium sphenoides*, *Clostridium symbiosum*, *Clostridium xylanolyticum*, *Eubacterium hadrum*, *Fusobacterium naviforme*, Lachnospiraceae bacterium 3_1_57FAA, Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_408b | *Anaerostipes caccae*, *Anaerostipes* sp. 3_2_56FAA, Clostridiales bacterium 1_7_47FAA, Clostridiales sp. SM4_1, Clostridiales sp. SSC_2. *Clostridium aerotolerans*, *Clostridium aldenense*, *Clostridium algidixylanolyticum*, *Clostridium amygdalinum*, *Clostridium asparagiforme*, *Clostridium bolteae*, *Clostridium celerecrescens*, *Clostridium citroniae*, *Clostridium clostridiiformes*, *Clostridium clostridioforme*, *Clostridium indolis*, *Clostridium lavalense*, *Clostridium saccharolyticum*, *Clostridium* sp. M62_1, *Clostridium* sp. SS2_1, *Clostridium sphenoides*, *Clostridium symbiosum*, *Clostridium xylanolyticum*, *Eubacterium hadrum*, *Fusobacterium naviforme*, Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_408d | *Anaerostipes caccae*, *Anaerostipes* sp. 3_2_56FAA, Clostridiales sp. SM4_1, Clostridiales sp. SSC_2, *Clostridium aerotolerans*, *Clostridium aldenense*, *Clostridium algidixylanolyticum*, *Clostridium amygdalinum*, *Clostridium celerecrescens*, *Clostridium citroniae*, *Clostridium clostridiiformes*, *Clostridium clostridioforme*, *Clostridium hathewayi*, *Clostridium lavalense*, *Clostridium saccharolyticum*, *Clostridium* sp. M62_1, *Clostridium* sp. SS2_1, *Clostridium sphenoides*, *Clostridium symbiosum*, *Clostridium xylanolyticum*, *Eubacterium hadrum*, *Fusobacterium naviforme*, Lachnospiraceae bacterium 3_1_57FAA, Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_408f | *Anaerostipes* sp. 3_2_56FAA, Clostridiales bacterium 1_7_47FAA, Clostridiales sp. SM4_1, Clostridiales sp. SSC_2, *Clostridium aerotolerans*, *Clostridium aldenense*, *Clostridium algidixylanolyticum*, *Clostridium amygdalinum*, *Clostridium asparagiforme*, *Clostridium bolteae*, *Clostridium celerecrescens*, *Clostridium citroniae*, *Clostridium clostridiiformes*, *Clostridium clostridioforme*, *Clostridium hathewayi*, *Clostridium lavalense*, *Clostridium saccharolyticum*, *Clostridium* sp. M62_1, *Clostridium* sp. SS2_1, *Clostridium sphenoides*, *Clostridium symbiosum*, *Clostridium xylanolyticum*, *Eubacterium hadrum*, *Fusobacterium naviforme*, Lachnospiraceae bacterium 3_1_57FAA, Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_408g | *Anaerostipes caccae*, *Anaerostipes* sp. 3_2_56FAA, Clostridiales sp. SM4_1, Clostridiales sp. SSC_2, *Clostridium aerotolerans*, *Clostridium aldenense*, *Clostridium algidixylanolyticum*, *Clostridium amygdalinum*, *Clostridium celerecrescens*, *Clostridium citroniae*, *Clostridium clostridiiformes*, |

TABLE 2-continued

| Phylogenetic Clade | OTUs in clade |
|---|---|
| | *Clostridium clostridioforme, Clostridium lavalense, Clostridium saccharolyticum, Clostridium* sp. M62_1, *Clostridium* sp. SS2_1, *Clostridium sphenoides, Clostridium symbiosum, Clostridium xylanolyticum, Eubacterium hadrum, Fusobacterium naviforme,* Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_408h | *Anaerostipes caccae, Anaerostipes* sp. 3_2_56FAA, Clostridiales sp. SM4_1, Clostridiales sp. SSC_2, *Clostridium aerotolerans, Clostridium aldenense, Clostridium algidixylanolyticum, Clostridium amygdalinum, Clostridium celerecrescens, Clostridium citroniae, Clostridium clostridiiformes, Clostridium clostridioforme, Clostridium lavalense, Clostridium saccharolyticum, Clostridium* sp. M62_1, *Clostridium* sp. SS2_1, *Clostridium sphenoides, Clostridium symbiosum, Clostridium xylanolyticum, Eubacterium hadrum, Fusobacterium naviforme,* Lachnospiraceae bacterium 5_1_63FAA, Lachnospiraceae bacterium A4, Lachnospiraceae bacterium DJF VP30, Lachnospiraceae genomosp. C1, *Moryella indoligenes* |
| clade_420 | *Barnesiella intestinihominis, Barnesiella viscericola, Parabacteroides* sp. NS31_3, Porphyromonadaceae bacterium NML 060648, *Tannerella forsythia, Tannerella* sp. 6_1_58FAA_CT1 |
| clade_420f | *Barnesiella viscericola, Parabacteroides* sp. NS31_3. Porphyromonadaceae bacterium NML 060648, *Tannerella forsythia, Tannerella* sp. 6_1_58FAA_CT1 |
| clade_444 | *Butyrivibrio fibrisolvens, Eubacterium rectale, Eubacterium* sp. oral clone GI038, *Lachnobacterium bovis, Roseburia cecicola, Roseburia faecalis, Roseburia faecis, Roseburia hominis, Roseburia intestinalis, Roseburia inulinivorans, Roseburia* sp. 11SE37, *Roseburia* sp. 11SE38, *Shuttleworthia satelles, Shuttleworthia* sp. MSX8B, *Shuttleworthia* sp. oral taxon G69 |
| clade_444i | *Butyrivibrio fibrisolvens, Eubacterium* sp. oral clone GI038, *Lachnobacterium bovis, Roseburia cecicola, Roseburia faecis, Roseburia hominis, Roseburia inulinivorans, Roseburia* sp. 11SE37, *Roseburia* sp. 11SE38, *Shuttleworthia satelles, Shuttleworthia* sp. MSX8B, *Shuttleworthia* sp. oral taxon G69 |
| clade_478 | *Faecalibacterium prausnitzii, Gemmiger formicilis, Subdoligranulum variabile* |
| clade_478i | *Gemmiger formicilis, Subdoligranulum variabile* |
| clade_479 | Clostridiaceae bacterium JC13, *Clostridium* sp. MLG055, Erysipelotrichaceae bacterium 3_1_53 |
| clade_479c | *Clostridium* sp. MLG055, Erysipelotrichaceae bacterium 3_1_53 |
| clade_479g | *Clostridium* sp. MLG055, Erysipelotrichaceae bacterium 3_1_53 |
| clade_479h | *Clostridium* sp. MLG055, Erysipelotrichaceae bacterium 3_1_53 |
| clade_481 | *Clostridium cocleatum, Clostridium ramosum, Clostridium saccharogumia, Clostridium spiroforme, Coprobacillus* sp. D7 |
| clade_481a | *Clostridium cocleatum, Clostridium spiroforme, Coprobacillus* sp. D7 |
| clade_481b | *Clostridium cocleatum, Clostridium ramosum, Clostridium spiroforme, Coprobacillus* sp. D7 |
| clade_481e | *Clostridium cocleatum, Clostridium saccharogumia, Clostridium spiroforme, Coprobacillus* sp. D7 |
| clade_481g | *Clostridium cocleatum, Clostridium spiroforme, Coprobacillus* sp. D7 |
| clade_481h | *Clostridium cocleatum, Clostridium spiroforme, Coprobacillus* sp. D7 |
| clade_481i | *Clostridium ramosum, Clostridium saccharogumia, Clostridium spiroforme, Coprobacillus* sp. D7 |
| clade_497 | *Abiotrophia para_adiacens, Carnobacterium divergens, Carnobacterium maltaromaticum, Enterococcus avium, Enterococcus caccae, Enterococcus casseliflavus, Enterococcus durans, Enterococcus faecalis, Enterococcus faecium, Enterococcus gallinarum, Enterococcus gilvus, Enterococcus hawaiiensis, Enterococcus hirae, Enterococcus italicus, Enterococcus mundtii, Enterococcus raffinosus, Enterococcus* sp. BV2CASA2, *Enterococcus* sp. CCRI 16620, *Enterococcus* sp. F95, *Enterococcus* sp. RfL6, *Enterococcus thailandieus, Fusobacterium canifelinum, Fusobacterium* genomosp. C1, *Fusobacterium* genomosp. C2, *Fusobacterium nucleatum, Fusobacterium periodonticum, Fusobacterium* sp. 11_3_2, *Fusobacterium* sp. 1_1_41FAA, *Fusobacterium* sp. 2_1_31, *Fusobacterium* sp. 3_1_27, *Fusobacterium* sp. 3_1_33, *Fusobacterium* sp. 3_1_36A2, *Fusobacterium* sp. AC18, *Fusobacterium* sp. ACB2, *Fusobacterium* sp. AS2, *Fusobacterium* sp. CM1, *Fusobacterium* sp. CM21. *Fusobacterium* sp. CM22, *Fusobacterium* sp. oral clone ASCF06, *Fusobacterium* sp. oral clone ASCF11, *Granulicatella adiacens, Granulicatella elegans, Granulicatella paradiacens, Granulicatella* sp. oral clone ASC02, *Granulicatella* sp. oral clone ASCA05, *Granulicatella* sp. oral clone ASCB09, *Granulicatella* sp. oral clone ASCG05, *Tetragenococcus halophilus, Tetragenococcus koreensis, Vagococcus fluvialis* |
| clade_497e | *Abiotrophia para_adiacens, Carnobacterium divergens, Carnobacterium maltaromaticum, Enterococcus avium, Enterococcus caccae, Enterococcus casseliflavus, Enterococcus durans, Enterococcus faecium, Enterococcus gallinarum, Enterococcus gilvus, Enterococcus hawaiiensis, Enterococcus hirae, Enterococcus italicus, Enterococcus mundtii, Enterococcus raffinosus, Enterococcus* sp. BV2CASA2, *Enterococcus* sp. CCRI 16620, *Enterococcus* sp. F95, *Enterococcus* sp. RfL6, *Enterococcus thailandieus, Fusobacterium canifelinum, Fusobacterium* genomosp. C1, *Fusobacterium* genomosp. C2, *Fusobacterium nucleatum, Fusobacterium periodonticum, Fusobacterium* sp. 11_3_2, *Fusobacterium* sp. 1_1_41FAA, *Fusobacterium* sp. 2_1_31, *Fusobacterium* sp. 3_1_27, *Fusobacterium* sp. 3_1_33, *Fusobacterium* sp. 3_1_36A2, *Fusobacterium* sp. AC18, *Fusobacterium* sp. ACB2, *Fusobacterium* sp. AS2, *Fusobacterium* sp. CM1, *Fusobacterium* sp. CM21, *Fusobacterium* sp. CM22, *Fusobacterium* sp. oral clone ASCF06, *Fusobacterium* sp. oral clone ASCF11, *Granulicatella adiacens, Granulicatella elegans, Granulicatella paradiacens, Granulicatella* sp. oral clone ASC02, *Granulicatella* sp. oral clone ASCA05, *Granulicatella* sp. oral clone ASCB09, *Granulicatella* sp. oral clone ASCG05, *Tetragenococcus halophilus, Tetragenococcus koreensis, Vagococcus fluvialis* |
| clade_497f | *Abiotrophia para_adiacens, Carnobacterium divergens, Carnobacterium maltaromaticum, Enterococcus avium, Enterococcus caccae, Enterococcus casseliflavus, Enterococcus faecalis, Enterococcus gallinarum, Enterococcus gilvus, Enterococcus hawaiiensis, Enterococcus italicus, Enterococcus mundtii, Enterococcus raffinosus, Enterococcus* sp. BV2CASA2, *Enterococcus* sp. CCRI 16620, *Enterococcus* sp. F95, *Enterococcus* sp. RfL6, *Enterococcus thailandicus, Fusobacterium canifelinum, Fusobacterium* genomosp. C1, *Fusobacterium* genomosp. C2, *Fusobacterium nucleatum, Fusobacterium periodonticum, Fusobacterium* sp. 11_3_2, *Fusobacterium* sp. 1_1_41FAA, *Fusobacterium* sp. 2_1_31, *Fusobacterium* sp. 3_1_27, *Fusobacterium* sp. 3_1_33, *Fusobacterium* sp. 3_1_36A2, *Fusobacterium* sp. AC18, *Fusobacterium* sp. ACB2, *Fusobacterium* sp. AS2, *Fusobacterium* sp. CM1, *Fusobacterium* sp. CM21, *Fusobacterium* sp. CM22, *Fusobacterium* sp. oral clone ASCF06, *Fusobacterium* sp. oral clone |

TABLE 2-continued

| Phylogenetic Clade | OTUs in clade |
|---|---|
| | ASCF11, *Granulicatella adiacens, Granulicatella elegans, Granulicatella paradiacens, Granulicatella* sp. oral clone ASC02, *Granulicatella* sp. oral clone ASCA05, *Granulicatella* sp. oral clone ASCB09, *Granulicatella* sp. oral clone ASCG05, *Tetragenococcus halophilus, Tetragenococcus koreensis, Vagococcus fluvialis* |
| clade_512 | *Eubacterium barkeri, Eubacterium callanderi, Eubacterium limosum, Pseudoramibacter alactolyticus* |
| clade_512i | *Eubacterium barkeri, Eubacterium callanderi, Pseudoramibacter alactolyticus* |
| clade_516 | *Anaerotruncus colihominis, Clostridium methylpentosum, Clostridium* sp. YIT 12070, *Hydrogenoanaerobacterium saccharovorans, Ruminococcus albus, Ruminococcus flavefaciens* |
| clade_516c | *Clostridium methylpentosum, Clostridium* sp. YIT 12070, *Hydrogenoanaerobacterium saccharovorans, Ruminococcus albus, Ruminococcus flavefaciens* |
| clade_516g | *Clostridium methylpentosum, Clostridium* sp. YIT 12070, *Hydrogenoanaerobacterium saccharovorans, Ruminococcus albus, Ruminococcus flavefaciens* |
| clade_516h | *Clostridium methylpentosum, Clostridium* sp. YIT 12070, *Hydrogenoanaerobacterium saccharovorans, Ruminococcus albus, Ruminococcus flavefaciens* |
| clade_519 | *Eubacterium ventriosum* |
| clade_522 | *Bacteroides galacturonicus, Eubacterium eligens, Lachnospira multipara, Lachnospira pectinoschiza, Lactobacillus rogosae* |
| clade_522i | *Bacteroides galacturonicus, Lachnospira multipara, Lachnospira pectinoschiza, Lactobacillus rogosae* |
| clade_553 | *Collinsella aerofaciens, Collinsella intestinalis, Collinsella stercoris, Collinsella tanakaei* |
| clade_553i | *Collinsella intestinalis, Collinsella stercoris, Collinsella tanakaei* |
| clade_566 | *Adlercreutzia equolifaciens,* Coriobacteriaceae bacterium JC110, Coriobacteriaceae bacterium phI, *Cryptobacterium curtum, Eggerthella lenta, Eggerthella sinensis, Eggerthella* sp. 1_3_56FAA, *Eggerthella* sp. HGA1, *Eggerthella* sp. YY7918, *Gordonibacter pamelaeae, Slackia equolifaciens, Slackia exigua, Slackia faecicanis, Slackia heliotrinireducens, Slackia isoflavoniconvertens, Slackia piriformis, Slackia* sp. NATTS, *Streptomyces albus* |
| clade_566f | Coriobacteriaceae bacterium JC110, Coriobacteriaceae bacterium phI, *Cryptobacterium curtum, Eggerthella lenta, Eggerthella sinensis, Eggerthella* sp. 1_3_56FAA, *Eggerthella* sp. HGA1, *Eggerthella* sp. YY7918, *Gordonibacter pamelaeae, Slackia equolifaciens, Slackia exigua, Slackia faecicanis, Slackia heliotrinireducens, Slackia isoflavoniconvertens, Slackia piriformis, Slackia* sp. NATTS, *Streptomyces albus* |
| clade_572 | *Butyricicoccus pullicaecorum, Eubacterium desmolans, Papillibacter cinnamivorans, Sporobacter termitidis* |
| clade_572i | *Butyricicoccus pullicaecorum, Papillibacter cinnamivorans, Sporobacter termitidis* |
| clade_65 | *Bacteroides faecis, Bacteroides fragilis, Bacteroides nordii, Bacteroides salyersiae, Bacteroides* sp. 1_1_14, *Bacteroides* sp. 1_1_6, *Bacteroides* sp. 2_1_56FAA, *Bacteroides* sp. AR29, *Bacteroides* sp. B2, *Bacteroides thetaiotaomicron* |
| clade_65e | *Bacteroides faecis, Bacteroides fragilis, Bacteroides nordii, Bacteroides salyersiae, Bacteroides* sp. 1_1_14, *Bacteroides* sp. 1_1_6, *Bacteroides* sp. 2_1_56FAA, *Bacteroides* sp. AR29, *Bacteroides* sp. B2 |
| clade_92 | *Actinobacillus actinomycetemcomitans, Actinobacillus succinogenes, Aggregatibacter actinomycetemcomitans, Aggregatibacter aphrophilus, Aggregatibacter segnis, Averyella dalhousiensis,* Bisgaard Taxon, *Buchnera aphidicola, Cedecea davisae, Citrobacter amalonaticus, Citrobacter braakii, Citrobacter farmeri, Citrobacter freundii, Citrobacter gillenii, Citrobacter koseri, Citrobacter murliniae, Citrobacter rodentium, Citrobacter sedlakii, Citrobacter* sp. 30_2, *Citrobacter* sp. KMSI_3, *Citrobacter werkmanii, Citrobacter youngae, Cronobacter malonaticus, Cronobacter sakazakii, Cronobacter turicensis, Enterobacter aerogenes, Enterobacter asburiae, Enterobacter cancerogenus, Enterobacter cloacae, Enterobacter cowanii, Enterobacter hormaechei, Enterobacter* sp. 247BMC, *Enterobacter* sp. 638, *Enterobacter* sp. JC163, *Enterobacter* sp. SCSS, *Enterobacter* sp. TSE38, Enterobacteriaceae bacterium 9_2_54FAA, Enterobacteriaceae bacterium CF01Ent_1, Enterobacteriaceae bacterium Smarlab 3302238, *Escherichia albertii, Escherichia coli, Escherichia fergusonii, Escherichia hermannii, Escherichia* sp. 1_1_43, *Escherichia* sp. 4_1_40B, *Escherichia* sp. B4, *Escherichia vulneris, Ewingella americana, Haemophilus* genomosp. P2 oral clone MB3_C24, *Haemophilus* genomosp. P3 oral clone MB3_C38, *Haemophilus* sp. oral clone JM053, *Hafnia alvei, Klebsiella oxytoca, Klebsiella pneumoniae, Klebsiella* sp. AS10, *Klebsiella* sp. Co9935, *Klebsiella* sp. OBRC7, *Klebsiella* sp. SP_BA, *Klebsiella* sp. SRC_DSD1, *Klebsiella* sp. SRC_DSD11, *Klebsiella* sp. SRC_DSD12, *Klebsiella* sp. SRC_DSD15, *Klebsiella* sp. SRC_DSD2, *Klebsiella* sp. SRC_DSD6, *Klebsiella* sp. enrichment culture clone SRC_DSD25, *Klebsiella variicola, Kluyvera ascorbata, Kluyvera cryocrescens, Leminorella grimontii, Leminorella richardii, Pantoea agglomerans, Pantoea ananatis, Pantoea brenneri, Pantoea citrea, Pantoea conspicua, Pantoea septica, Pasteurella dagmatis, Pasteurella multocida, Plesiomonas shigelloides, Raoultella ornithinolytica, Raoultella planticola, Raoultella terrigena, Salmonella bongori, Salmonella enterica, Salmonella typhimurium, Serratia fonticola, Serratia liquefaciens, Serratia marcescens, Serratia odorifera, Serratia proteamaculans, Shigella boydii, Shigella dysenteriae, Shigella flexneri, Shigella sonnei, Tatumella ptyseos, Trabulsiella guamensis, Yersinia aldovae, Yersinia aleksiciae, Yersinia bercovieri, Yersinia enterocolitica, Yersinia frederiksenii, Yersinia intermedia, Yersinia kristensenii, Yersinia mollaretii, Yersinia pestis, Yersinia pseudotuberculosis, Yersinia rohdei, Yokenella regensburgei* |
| clade_92e | *Actinobacillus actinomycetemcomitans, Actinobacillus succinogenes, Aggregatibacter actinomycetemcomitans, Aggregatibacter aphrophilus, Aggregatibacter segnis, Averyella dalhousiensis,* Bisgaard Taxon, *Buchnera aphidicola, Cedecea davisae, Citrobacter amalonaticus, Citrobacter braakii, Citrobacter farmeri, Citrobacter freundii, Citrobacter gillenii, Citrobacter koseri, Citrobacter murliniae, Citrobacter rodentium, Citrobacter sedlakii, Citrobacter* sp. 30_2, *Citrobacter* sp. KMSI_3, *Citrobacter werkmanii, Citrobacter youngae, Cronobacter malonaticus, Cronobacter sakazakii, Cronobacter turicensis, Enterobacter aerogenes, Enterobacter asburiae, Enterobacter cancerogenus, Enterobacter cloacae, Enterobacter cowanii, Enterobacter hormaechei, Enterobacter* sp. 247BMC, *Enterobacter* sp. 638, *Enterobacter* sp. JC163, *Enterobacter* sp. SCSS, *Enterobacter* sp. TSE38, Enterobacteriaceae bacterium 9_2_54FAA, Enterobacteriaceae bacterium CF01Ent_1, Enterobacteriaceae bacterium Smarlab 3302238, *Escherichia albertii, Escherichia fergusonii, Escherichia hermannii, Escherichia* sp. 1_1_43, *Escherichia* sp. 4_1_40B, *Escherichia* sp. B4, *Escherichia vulneris, Ewingella americana,* |

TABLE 2-continued

| Phylogenetic Clade | OTUs in clade |
|---|---|
| | *Haemophilus* genomosp. P2 oral clone MB3_C24, *Haemophilus* genomosp. P3 oral clone MB3_C38, *Haemophilus* sp. oral clone JM053, *Hafnia alvei*, *Klebsiella oxytoca*, *Klebsiella pneumoniae*, *Klebsiella* sp. AS10, *Klebsiella* sp. Co9935, *Klebsiella* sp. OBRC7, *Klebsiella* sp. SP_BA, *Klebsiella* sp. SRC_DSD1, *Klebsiella* sp. SRC_DSD11, *Klebsiella* sp. SRC_DSD12, *Klebsiella* sp. SRC_DSD15, *Klebsiella* sp. SRC_DSD2, *Klebsiella* sp. SRC_DSD6, *Klebsiella* sp. enrichment culture clone SRC_DSD25, *Klebsiella variicola*, *Kluyvera ascorbata*, *Kluyvera cryocrescens*, *Leminorella grimontii*, *Leminorella richardii*, *Pantoea agglomerans*, *Pantoea ananatis*, *Pantoea brenneri*, *Pantoea citrea*, *Pantoea conspicua*, *Pantoea septica*, *Pasteurella dagmatis*, *Pasteurella multocida*, *Plesiomonas shigelloides*, *Raoultella ornithinolytica*, *Raoultella planticola*, *Raoultella terrigena*, *Salmonella bongori*, *Salmonella enterica*, *Salmonella typhimurium*, *Serratia fonticola*, *Serratia liquefaciens*, *Serratia marcescens*, *Serratia odorifera*, *Serratia proteamaculans*, *Shigella boydii*, *Shigella dysenteriae*, *Shigella flexneri*, *Shigella sonnei*, *Tatumella ptyseos*, *Trabulsiella guamensis*, *Yersinia aldovae*, *Yersinia aleksiciae*, *Yersinia bercovieri*, *Yersinia enterocolitica*, *Yersinia frederiksenii*, *Yersinia intermedia*, *Yersinia kristensenii*, *Yersinia mollaretii*, *Yersinia pestis*, *Yersinia pseudotuberculosis*, *Yersinia rohdei*, *Yokenella regensburgei* |
| clade_92i | *Actinobacillus actinomycetemcomitans*, *Actinobacillus succinogenes*, *Aggregatibacter actinomycetemcomitans*, *Aggregatibacter aphrophilus*, *Aggregatibacter segnis*, *Averyella dalhousiensis*, Bisgaard Taxon, *Buchnera aphidicola*, *Cedecea davisae*, *Citrobacter amalonaticus*, *Citrobacter braakii*, *Citrobacter farmeri*, *Citrobacter freundii*, *Citrobacter gillenii*, *Citrobacter koseri*, *Citrobacter murliniae*, *Citrobacter rodentium*, *Citrobacter sedlakii*, *Citrobacter* sp. 30_2, *Citrobacter* sp. KMSI_3, *Citrobacter werkmanii*, *Citrobacter youngae*, *Cronobacter malonaticus*, *Cronobacter sakazakii*, *Cronobacter turicensis*, *Enterobacter aerogenes*, *Enterobacter asburiae*, *Enterobacter cancerogenus*, *Enterobacter cloacae*, *Enterobacter cowanii*, *Enterobacter hormaechei*, *Enterobacter* sp. 247BMC, *Enterobacter* sp. 638, *Enterobacter* sp. JC163, *Enterobacter* sp. SCSS, *Enterobacter* sp. TSE38, Enterobacteriaceae bacterium 9_2_54FAA, Enterobacteriaceae bacterium CF01Ent_1, Enterobacteriaceae bacterium Smarlab 3302238, *Escherichia albertii*, *Escherichia fergusonii*, *Escherichia hermannii*, *Escherichia* sp. 1_1_43, *Escherichia* sp. 4_1_40B, *Escherichia* sp. B4, *Escherichia vulneris*, *Ewingella americana*, *Haemophilus* genomosp. P2 oral clone MB3_C24, *Haemophilus* genomosp. P3 oral clone MB3_C38, *Haemophilus* sp. oral clone JM053, *Hafnia alvei*, *Klebsiella oxytoca*, *Klebsiella pneumoniae*, *Klebsiella* sp. AS10, *Klebsiella* sp. Co9935, *Klebsiella* sp. OBRC7, *Klebsiella* sp. SP_BA, *Klebsiella* sp. SRC_DSD1, *Klebsiella* sp. SRC_DSD11, *Klebsiella* sp. SRC_DSD12, *Klebsiella* sp. SRC_DSD15, *Klebsiella* sp. SRC_DSD2, *Klebsiella* sp. SRC_DSD6, *Klebsiella* sp. enrichment culture clone SRC_DSD25, *Klebsiella variicola*, *Kluyvera ascorbata*, *Kluyvera cryocrescens*, *Leminorella grimontii*, *Leminorella richardii*, *Pantoea agglomerans*, *Pantoea ananatis*, *Pantoea brenneri*, *Pantoea citrea*, *Pantoea conspicua*, *Pantoea septica*, *Pasteurella dagmatis*, *Pasteurella multocida*, *Plesiomonas shigelloides*, *Raoultella ornithinolytica*, *Raoultella planticola*, *Raoultella terrigena*, *Salmonella bongori*, *Salmonella enterica*, *Salmonella typhimurium*, *Serratia fonticola*, *Serratia liquefaciens*, *Serratia marcescens*, *Serratia odorifera*, *Serratia proteamaculans*, *Shigella boydii*, *Shigella dysenteriae*, *Shigella flexneri*, *Shigella sonnei*, *Tatumella ptyseos*, *Trabulsiella guamensis*, *Yersinia aldovae*, *Yersinia aleksiciae*, *Yersinia bercovieri*, *Yersinia enterocolitica*, *Yersinia frederiksenii*, *Yersinia intermedia*, *Yersinia kristensenii*, *Yersinia mollaretii*, *Yersinia pestis*, *Yersinia pseudotuberculosis*, *Yersinia rohdei*, *Yokenella regensburgei* |
| clade_96 | *Clostridium oroticum*, *Clostridium* sp. D5, *Eubacterium contortum*, *Eubacterium fissicatena* |
| clade_96g | *Clostridium oroticum*, *Clostridium* sp. D5, *Eubacterium fissicatena* |
| clade_96h | *Clostridium oroticum*, *Clostridium* sp. D5, *Eubacterium fissicatena* |
| clade_98 | *Okadaella gastrococcus*, *Streptococcus agalactiae*, *Streptococcus alactolyticus*, *Streptococcus australis*, *Streptococcus bovis*, *Streptococcus canis*, *Streptococcus constellatus*, *Streptococcus cristatus*, *Streptococcus dysgalactiae*, *Streptococcus equi*, *Streptococcus equinus*, *Streptococcus gallolyticus*, *Streptococcus* genomosp. C1, *Streptococcus* genomosp. C2, *Streptococcus* genomosp. C3, *Streptococcus* genomosp. C4, *Streptococcus* genomosp. C5, *Streptococcus* genomosp. C6, *Streptococcus* genomosp. C7, *Streptococcus* genomosp. C8, *Streptococcus gordonii*, *Streptococcus infantarius*, *Streptococcus infantis*, *Streptococcus intermedius*, *Streptococcus lutetiensis*, *Streptococcus massiliensis*, *Streptococcus mitis*, *Streptococcus oligofermentans*, *Streptococcus oralis*, *Streptococcus parasanguinis*, *Streptococcus pasteurianus*, *Streptococcus peroris*, *Streptococcus pneumoniae*, *Streptococcus porcinus*, *Streptococcus pseudopneumoniae*, *Streptococcus pseudoporcinus*, *Streptococcus pyogenes*, *Streptococcus ratti*, *Streptococcus salivarius*, *Streptococcus sanguinis*, *Streptococcus sinensis*, *Streptococcus* sp. 2285_97, *Streptococcus* sp. 2_1_36FAA, *Streptococcus* sp. ACS2, *Streptococcus* sp. AS20, *Streptococcus* sp. BS35a, *Streptococcus* sp. C150, *Streptococcus* sp. CM6, *Streptococcus* sp. ICM10, *Streptococcus* sp. ICM12, *Streptococcus* sp. ICM2, *Streptococcus* sp. ICM4, *Streptococcus* sp. ICM45, *Streptococcus* sp. M143, *Streptococcus* sp. M334, *Streptococcus* sp. oral clone ASB02, *Streptococcus* sp. oral clone ASCA03, *Streptococcus* sp. oral clone ASCA04, *Streptococcus* sp. oral clone ASCA09, *Streptococcus* sp. oral clone ASCB04, *Streptococcus* sp. oral clone ASCB06, *Streptococcus* sp. oral clone ASCC04, *Streptococcus* sp. oral clone ASCC05, *Streptococcus* sp. oral clone ASCC12, *Streptococcus* sp. oral clone ASCD01, *Streptococcus* sp. oral clone ASCD09, *Streptococcus* sp. oral clone ASCD10, *Streptococcus* sp. oral clone ASCE03, *Streptococcus* sp. oral clone ASCE04, *Streptococcus* sp. oral clone ASCE05, *Streptococcus* sp. oral clone ASCE06, *Streptococcus* sp. oral clone ASCE09, *Streptococcus* sp. oral clone ASCE10, *Streptococcus* sp. oral clone ASCE12, *Streptococcus* sp. oral clone ASCF05, *Streptococcus* sp. oral clone ASCF07, *Streptococcus* sp. oral clone ASCF09, *Streptococcus* sp. oral clone ASCG04, *Streptococcus* sp. oral clone RW009, *Streptococcus* sp. oral clone CH016, *Streptococcus* sp. oral clone GK051, *Streptococcus* sp. oral clone GM006, *Streptococcus* sp. oral clone P2PA_41 P2, *Streptococcus* sp. oral clone P4PA_30 P4, *Streptococcus* sp. oral taxon 071, *Streptococcus* sp. oral taxon G59, *Streptococcus* sp. oral taxon G62, *Streptococcus* sp. oral taxon G63, *Streptococcus suis*, *Streptococcus thermophilus*, *Streptococcus uberis*, *Streptococcus urinalis*, *Streptococcus vestibularis*, *Streptococcus viridans*, Synergistetes bacterium oral clone 03 5 D05 |
| clade_98i | *Okadaella gastrococcus*, *Streptococcus agalactiae*, *Streptococcus alactolyticus*, *Streptococcus australis*, *Streptococcus bovis*, *Streptococcus canis*, *Streptococcus constellatus*, *Streptococcus cristatus*, *Streptococcus dysgalactiae*, *Streptococcus equi*, *Streptococcus equinus*, *Streptococcus gallolyticus*, |

TABLE 2-continued

| Phylogenetic Clade | OTUs in clade |
|---|---|
| | *Streptococcus* genomosp. C1, *Streptococcus* genomosp. C2, *Streptococcus* genomosp. C3, *Streptococcus* genomosp. C4, *Streptococcus* genomosp. C5, *Streptococcus* genomosp. C6, *Streptococcus* genomosp. C7, *Streptococcus* genomosp. C8, *Streptococcus gordonii*, *Streptococcus infantarius*, *Streptococcus infantis*, *Streptococcus intermedius*, *Streptococcus lutetiensis*, *Streptococcus massiliensis*, *Streptococcus oligofermentans*, *Streptococcus oralis*, *Streptococcus parasanguinis*, *Streptococcus pasteurianus*, *Streptococcus peroris*, *Streptococcus pneumoniae*, *Streptococcus porcinus*, *Streptococcus pseudopneumoniae*, *Streptococcus pseudoporcinus*, *Streptococcus pyogenes*, *Streptococcus ratti*, *Streptococcus salivarius*, *Streptococcus sanguinis*, *Streptococcus sinensis*, *Streptococcus* sp. 2285__97, *Streptococcus* sp. 2__1__36FAA, *Streptococcus* sp. ACS2, *Streptococcus* sp. AS20, *Streptococcus* sp. BS35a, *Streptococcus* sp. C150, *Streptococcus* sp. CM6, *Streptococcus* sp. ICM10, *Streptococcus* sp. ICM12, *Streptococcus* sp. ICM2, *Streptococcus* sp. ICM4, *Streptococcus* sp. ICM45, *Streptococcus* sp. M143, *Streptococcus* sp. M334, *Streptococcus* sp. oral clone ASB02, *Streptococcus* sp. oral clone ASCA03, *Streptococcus* sp. oral clone ASCA04, *Streptococcus* sp. oral clone ASCA09, *Streptococcus* sp. oral clone ASCB04, *Streptococcus* sp. oral clone ASCB06, *Streptococcus* sp. oral clone ASCC04, *Streptococcus* sp. oral clone ASCC05, *Streptococcus* sp. oral clone ASCC12, *Streptococcus* sp. oral clone ASCD01, *Streptococcus* sp. oral clone ASCD09, *Streptococcus* sp. oral clone ASCD10, *Streptococcus* sp. oral clone ASCE03, *Streptococcus* sp. oral clone ASCE04, *Streptococcus* sp. oral clone ASCE05, *Streptococcus* sp. oral clone ASCE06, *Streptococcus* sp. oral clone ASCE09, *Streptococcus* sp. oral clone ASCE10, *Streptococcus* sp. oral clone ASCE12, *Streptococcus* sp. oral clone ASCF05, *Streptococcus* sp. oral clone ASCF07, *Streptococcus* sp. oral clone ASCF09, *Streptococcus* sp. oral clone ASCG04, *Streptococcus* sp. oral clone BW009, *Streptococcus* sp. oral clone CH016, *Streptococcus* sp. oral clone GK051, *Streptococcus* sp. oral clone GM006, *Streptococcus* sp. oral clone P2PA__41 P2, *Streptococcus* sp. oral clone P4PA__30 P4, *Streptococcus* sp. oral taxon 071, *Streptococcus* sp. oral taxon G59, *Streptococcus* sp. oral taxon G62, *Streptococcus* sp. oral taxon G63, *Streptococcus suis*, *Streptococcus thermophilus*, *Streptococcus uberis*, *Streptococcus urinalis*, *Streptococcus vestibularis*, *Streptococcus viridans*, Synergistetes bacterium oral clone 03 5 D05 |

TABLE 3

| Disease indication |
|---|
| Abdominal cavity inflammation |
| *Absidia* infection |
| *Acinetobacter baumanii* infection |
| *Acinetobacter* infection |
| *Acinetobacter lwoffii* infection |
| Acne |
| *Actinomyces israelii* infection |
| Adenovirus infection |
| Adult varicella zoster virus infection |
| Aging |
| Alcoholism (and effects) |
| Allergic conjunctivitis |
| Allergic rhinitis |
| Allergy |
| ALS |
| Alzheimers disease |
| Amoeba infection |
| Anal cancer |
| Antibiotic treatment |
| Antitbiotic associated diarrhea |
| Arteriosclerosis |
| Arthritis |
| *Aspergillus fumigatus* infection |
| *Aspergillus* infection |
| Asthma |
| Atherosclerosis |
| Atopic dermatitis |
| Atopy/Allergic Sensitivity |
| Autism |
| Autoimmune disease |
| *Bacillus anthracis* infection |
| *Bacillus* infection |
| Bacterial endocarditis |
| Bacterial eye infection |
| Bacterial infection |
| Bacterial meningitis |
| Bacterial pneumonia |
| Bacterial respiratory tract infection |
| Bacterial skin infection |
| Bacterial susceptibility |
| Bacterial urinary tract infection |
| Bacterial vaginosis |
| *Bacteroides caccae* infection |
| *Bacteroides fragilis* infection |
| *Bacteroides* infection |
| *Bacteroides thetaiotaomicron* infection |
| *Bacteroides uniformis* infection |
| *Bacteroides vulgatus* infection |
| *Bartonella bacilliformis* infection |
| *Bartonella* infection |
| *Bifidobacterium* infection |
| Biliary cancer |
| Biliary cirrhosis |
| Biliary tract disease |
| Biliary tract infection |
| Biliary tumor |
| BK virus infection |
| *Blastomyces* infection |
| Bone and joint infection |
| Bone infection |
| *Bordetella pertussis* infection |
| *Borrelia burgdorferi* infection |
| *Borrelia recurrentis* infection |
| *Brucella* infection |
| *Burkholderia* infection |
| Cachexia |
| *Campylobacter* fetus infection |
| *Campylobacter* infection |
| *Campylobacter jejuni* infection |
| Cancer |
| *Candida albicans* infection |
| *Candida* infection |
| *Candida krusei* infection |
| Celiac Disease |
| Cervix infection |
| Chemotherapy-induced diarrhea |
| *Chlamydia* infection |
| *Chlamydia pneumoniae* infection |
| *Chlamydia trachomatis* infection |
| Chlamydiae infection |
| Chronic fatigue syndrome |
| Chronic infection |
| Chronic inflammatory demyelinating polyneuropathy |
| Chronic Polio Shedders |
| Circadian rhythm sleep disorder |
| Cirrhosis |

TABLE 3-continued

| Disease indication |
|---|
| *Citrobacter* infection |
| *Cladophialophora* infection |
| Clostridiaceae infection |
| *Clostridium botulinum* infection |
| *Clostridium difficile* infection |
| *Clostridium* infection |
| *Clostridium tetani* infection |
| *Coccidioides* infection |
| Colitis |
| Colon cancer |
| Colorectal cancer |
| Common cold |
| Compensated liver cirrhosis |
| Complicated skin and skin structure infection |
| Complicated urinary tract infection |
| Constipation |
| Constipation predominant irritable bowel syndrome |
| *Corynebacterium diphtheriae* infection |
| *Corynebacterium* infection |
| *Coxiella* infection |
| carbapenem-resistant Enterobacteriaceae (CRE) infection |
| Crohns disease |
| *Cryptococcus* infection |
| *Cryptococcus neoformans* infection |
| *Cryptosporidium* infection |
| Cutaneous lupus erythematosus |
| Cystic fibrosis |
| Cystitis |
| Cytomegalovirus infection |
| Dementia |
| Dengue virus infection |
| Depression |
| Dermatitis |
| Diabetes mellitus |
| Diabetic complication |
| Diabetic foot ulcer |
| Diarrhea |
| Diarrhea predominant irritable bowel syndrome |
| Discoid lupus erythematosus |
| Diverticulitis |
| DNA virus infection |
| Duodenal ulcer |
| Ebola virus infection |
| *Entamoeba histolytica* infection |
| *Enterobacter aerogenes* infection |
| *Enterobacter cloacae* infection |
| *Enterobacter* infection |
| Enterobacteriaceae infection |
| *Enterococcus faecalis* infection |
| *Enterococcus faecium* infection |
| *Enterococcus* infection |
| Enterocolitis |
| Enterovirus 71 infection |
| *Epidermophyton* infection |
| Epstein Barr virus infection |
| ESBL (Extended Spectrum Beta Lactamase) Producing Bacterial Infection |
| *Escherichia coli* infection |
| Esophageal cancer |
| *Exophiala* infection |
| Familial cold autoinflammatory syndrome |
| *Fasciola hepatica* infection |
| Female genital tract infection |
| Female genital tract tumor |
| Female infertility |
| Fibrosis |
| Flavivirus infection |
| Food Allergy |
| *Francisella tularensis* infection |
| Functional bowel disorder |
| Fungal infection |
| Fungal respiratory tract infection |
| Fungal urinary tract infection |
| *Fusarium* infection |
| *Fusobacterium* infection |
| Gastric ulcers |
| Gastrointestinal infection |
| Gastrointestinal pain |
| Gastrointestinal ulcer |
| Genital tract infection |
| Genitourinary disease |
| Genitourinary tract rumor |
| Gestational diabetes |
| *Giardia lamblia* infection |
| Gingivitis |
| Gram negative bacterium infection |
| Gram positive bacterium infection |
| *Haemophilus aegyptus* infection |
| *Haemophilus ducreyi* infection |
| *Haemophilus* infection |
| *Haemophilus influenzae* infection |
| *Haemophilus parainfluenzae* infection |
| Hantavirus infection |
| *Helicobacter pylori* infection |
| Helminth infection |
| Hepatitis A virus infection |
| Hepatitis B virus infection |
| Hepatitis C virus infection |
| Hepatitis D virus infection |
| Hepatitis E virus infection |
| Hepatitis virus infection |
| Herpes simplex virus infection |
| Herpesvirus infection |
| *Histoplasma* infection |
| HIV infection |
| HIV-1 infection |
| HIV-2 infection |
| HSV-1 infection |
| HSV-2 infection |
| Human T cell leukemia virus 1 infection |
| Hypercholesterolemia |
| Hyperoxaluria |
| Hypertension |
| Infectious arthritis |
| Infectious disease |
| Infectious endocarditis |
| Infertility |
| Inflammatory bowel disease |
| Inflammatory disease |
| Influenza virus A infection |
| Influenza virus B infection |
| Influenza virus infection |
| Insomnia |
| Insulin dependent diabetes |
| Intestine infection |
| Irritable bowel syndrome |
| Japanese encephalitis virus infection |
| Joint infection |
| Juvenile rheumatoid arthritis |
| *Klebsiella granulomatis* infection |
| *Klebsiella* infection |
| *Klebsiella pneumoniae* infection |
| *Legionella* infection |
| *Legionella pneumophila* infection |
| *Leishmania braziliensis* infection |
| *Leishmania donovani* infection |
| *Leishmania* infection |
| *Leishmania tropica* infection |
| Leptospiraceae infection |
| *Listeria monocytogenes* infection |
| Listerosis |
| Liver cirrhosis |
| Liver fibrosis |
| Lower respiratory tract infection |
| Lung infection |
| Lung inflammation |
| Lupus erythematosus panniculitis |
| Lupus nephritis |
| Lyme disease |
| Male infertility |
| Marburg virus infection |
| Measles virus infection |
| Metabolic disorder |
| Metabolic Syndrome |
| Metastatic colon cancer |
| Metastatic colorectal cancer |

TABLE 3-continued

Disease indication

Metastatic esophageal cancer
Metastatic gastrointestinal cancer
Metastatic stomach cancer
Micrococcaceae infection
*Micrococcus* infection
Microsporidial infection
*Microsporum* infection
*Molluscum contagiosum* infection
Monkeypox virus infection
*Moraxella catarrhalis* infection
*Moraxella* infection
*Morganella* infection
*Morganella morganii* infection
MRSA infection
Mucor infection
Multidrug resistant infection
Multiple sclerosis
Mumps virus infection
Musculoskeletal system inflammation
*Mycobacterium* infection
*Mycobacterium leprae* infection
*Mycobacterium tuberculosis* infection
*Mycoplasma* infection
*Mycoplasma pneumoniae* infection
Necrotizing enterocolitis
Necrotizing Pancreatitis
*Neisseria gonorrhoeae* infection
*Neisseria* infection
*Neisseria meningitidis* infection
Nematode infection
Non alcoholic fatty liver disease
Non-alcoholic steatohepatitis
Non-insulin dependent diabetes
Obesity
Ocular infection
Ocular inflammation
Orbital inflammatory disease
Osteoarthritis
Otorhinolaryngological infection
Pain
Papillomavirus infection
Parasitic infection
Parkinsons disease
Pediatric varicella zoster virus infection
Pelvic inflammatory disease
*Peptostreptococcus* infection
Perennial allergic rhinitis
Periarthritis
Pink eye infection
*Plasmodium falciparum* infection
*Plasmodium* infection
*Plasmodium malariae* infection
*Plasmodium vivax* infection
*Pneumocystis carinii* infection
Poliovirus infection
Polyomavirus infection
Post-surgical bacterial leakage
Pouchitis
*Prevotella* infection
Primary biliary cirrhosis
Primary sclerosing cholangitis
*Propionibacterium acnes* infection
*Propionibacterium* infection
Prostate cancer
*Proteus* infection
*Proteus mirabilis* infection
Protozoal infection
*Providencia* infection
*Pseudomonas aeruginosa* infection
*Pseudomonas* infection
Psoriasis
Psoriatic arthritis
Pulmonary fibrosis
Rabies virus infection
Rectal cancer
Respiratory syncytial virus infection
Respiratory tract infection
Respiratory tract inflammation
Rheumatoid arthritis
Rhinitis
*Rhizomucor* infection
*Rhizopus* infection
*Rickettsia* infection
Ross River virus infection
Rotavirus infection
Rubella virus infection
*Salmonella* infection
*Salmonella typhi* infection
Sarcopenia
SARS coronavirus infection
Scabies infection
*Scedosporium* infection
Scleroderma
Seasonal allergic rhinitis
*Serratia* infection
*Serratia marcescens* infection
*Shigella boydii* infection
*Shigella dysenteriae* infection
*Shigella flexneri* infection
*Shigella* infection
*Shigella sonnei* infection
Short bowel syndrome
Skin allergy
Skin cancer
Skin infection
Skin Inflammatory disease
Sleep disorder
Spondylarthritis
*Staphylococcus aureus* infection
*Staphylococcus epidermidis* infection
*Staphylococcus* infection
*Staphylococcus saprophyticus* infection
*Stenotrophomonas maltophilia* infection
Stomach cancer
Stomach infection
Stomach ulcer
*Streptococcus agalactiae* infection
*Streptococcus constellatus* infection
*Streptococcus* infection
*Streptococcus intermedius* infection
*Streptococcus mitis* infection
*Streptococcus oralis* infection
*Streptococcus pneumoniae* infection
*Streptococcus pyogenes* infection
Systemic lupus erythematosus
Traveler's diarrhea
Trench mouth
*Treponema* infection
*Treponema pallidum* infection
*Trichomonas* infection
*Trichophyton* infection
*Trypanosoma brucei* infection
*Trypanosoma cruzi* infection
Type 1 Diabetes
Type 2 Diabetes
Ulcerative colitis
Upper respiratory tract infection
*Ureaplasma urealyticum* infection
Urinary tract disease
Urinary tract infection
Urinary tract tumor
Urogenital tract infection
Uterus infection
Vaccinia virus infection
Vaginal infection
*Varicella zoster* virus infection
Variola virus infection
*Vibrio cholerae* infection
Viral eye infection
Viral infection
Viral respiratory tract infection
Viridans group *Streptococcus* infection
Vancomycin-Resistant *Enterococcus* Infection
Wasting Syndrome
Weight loss
West Nile virus infection TABLE 3-continued

| Disease indication |
|---|
| Whipple's disease |
| Xenobiotic metabolism |
| Yellow fever virus infection |
| *Yersinia pestis* infection |
| Flatulence |
| Gastrointestinal Disorder |
| General Inflammation |

TABLE 4a

| OTU1 of Composition | OTU2 of Composition | OTU3 of Composition | Strain ID OTU1 | Strain ID OTU2 | Strain ID OTU3 (If applicable) |
|---|---|---|---|---|---|
| Escherichia_coli | Escherichia_coli | | SPC00001 | SPC00001 | |
| Escherichia_coli | Bacteroides_vulgatus | | SPC00001 | SPC00005 | |
| Escherichia_coli | Bacteroides_sp_1_1_6 | | SPC00001 | SPC00006 | |
| Escherichia_coli | Bacteroides_sp_3_1_23 | | SPC00001 | SPC00007 | |
| Escherichia_coli | Enterococcus_faecalis | | SPC00001 | SPC00008 | |
| Escherichia_coli | Coprobacillus_sp_D7 | | SPC00001 | SPC00009 | |
| Escherichia_coli | Streptococcus_thermophilus | | SPC00001 | SPC00015 | |
| Escherichia_coli | Dorea_formicigenerans | | SPC00001 | SPC00018 | |
| Escherichia_coli | Blautia_producta | | SPC00001 | SPC00021 | |
| Escherichia_coli | Eubacterium_eligens | | SPC00001 | SPC00022 | |
| Escherichia_coli | Clostridium_nexile | | SPC00001 | SPC00026 | |
| Escherichia_coli | Clostridium_sp_HGF2 | | SPC00001 | SPC00027 | |
| Escherichia_coli | Faecalibacterium_prausnitzii | | SPC00001 | SPC00054 | |
| Escherichia_coli | Odoribacter_splanchnicus | | SPC00001 | SPC00056 | |
| Escherichia_coli | Dorea_longicatena | | SPC00001 | SPC00057 | |
| Escherichia_coli | Roseburia_intestinalis | | SPC00001 | SPC00061 | |
| Escherichia_coli | Coprococcus_catus | | SPC00001 | SPC00080 | |
| Escherichia_coli | Erysipelotrichaceae_bacterium_3_1_53 | | SPC00001 | SPC10001 | |
| Escherichia_coli | Bacteroides_sp_D20 | | SPC00001 | SPC10019 | |
| Escherichia_coli | Bacteroides_ovatus | | SPC00001 | SPC10030 | |
| Escherichia_coli | Parabacteroides_merdae | | SPC00001 | SPC10048 | |
| Escherichia_coli | Bacteroides_vulgatus | | SPC00001 | SPC10081 | |
| Escherichia_coli | Collinsella_aerofaciens | | SPC00001 | SPC10097 | |
| Escherichia_coli | Escherichia_coli | | SPC00001 | SPC10110 | |
| Escherichia_coli | Ruminococcus_obeum | | SPC00001 | SPC10197 | |
| Escherichia_coli | Bacteroides_caccae | | SPC00001 | SPC10211 | |
| Escherichia_coli | Bacteroides_eggerthii | | SPC00001 | SPC10213 | |
| Escherichia_coli | Ruminococcus_torques | | SPC00001 | SPC10233 | |
| Escherichia_coli | Clostridium_hathewayi | | SPC00001 | SPC10243 | |
| Escherichia_coli | Bifidobacterium_pseudocatenulatum | | SPC00001 | SPC10298 | |
| Escherichia_coli | Bifidobacterium_adolescentis | | SPC00001 | SPC10301 | |
| Escherichia_coli | Coprococcus_comes | | SPC00001 | SPC10304 | |
| Escherichia_coli | Clostridium_symbiosum | | SPC00001 | SPC10355 | |
| Escherichia_coli | Eubacterium_rectale | | SPC00001 | SPC10363 | |
| Escherichia_coli | Faecalibacterium_prausnitzii | | SPC00001 | SPC10386 | |
| Escherichia_coli | Odoribacter_splanchnicus | | SPC00001 | SPC10388 | |
| Escherichia_coli | Lachnospiraceae_bacterium_5_1_57FAA | | SPC00001 | SPC10390 | |
| Escherichia_coli | Blautia_schinkii | | SPC00001 | SPC10403 | |
| Escherichia_coli | Alistipes_shahii | | SPC00001 | SPC10414 | |
| Escherichia_coli | Blautia_producta | | SPC00001 | SPC10415 | |
| Bacteroides_vulgatus | Bacteroides_vulgatus | | SPC00005 | SPC00005 | |
| Bacteroides_vulgatus | Bacteroides_sp_1_1_6 | | SPC00005 | SPC00006 | |
| Bacteroides_vulgatus | Bacteroides_sp_3_1_23 | | SPC00005 | SPC00007 | |
| Bacteroides_vulgatus | Enterococcus_faecalis | | SPC00005 | SPC00008 | |
| Bacteroides_vulgatus | Coprobacillus_sp_D7 | | SPC00005 | SPC00009 | |
| Bacteroides_vulgatus | Streptococcus_thermophilus | | SPC00005 | SPC00015 | |
| Bacteroides_vulgatus | Dorea_formicigenerans | | SPC00005 | SPC00018 | |
| Bacteroides_vulgatus | Blautia_producta | | SPC00005 | SPC00021 | |

TABLE 4a-continued

| | | |
|---|---|---|
| Bacteroides_vulgatus | Eubacterium_eligens | SPC00005 SPC00022 |
| Bacteroides_vulgatus | Clostridium_nexile | SPC00005 SPC00026 |
| Bacteroides_vulgatus | Clostridium_sp_HGF2 | SPC00005 SPC00027 |
| Bacteroides_vulgatus | Faecalibacterium_prausnitzii | SPC00005 SPC00054 |
| Bacteroides_vulgatus | Odoribacter_splanchnicus | SPC00005 SPC00056 |
| Bacteroides_vulgatus | Dorea_longicatena | SPC00005 SPC00057 |
| Bacteroides_vulgatus | Roseburia_intestinalis | SPC00005 SPC00061 |
| Bacteroides_vulgatus | Coprococcus_catus | SPC00005 SPC00080 |
| Bacteroides_vulgatus | Erysipelotrichaceae_bacterium_3_1_53 | SPC00005 SPC10001 |
| Bacteroides_vulgatus | Bacteroides_sp_D20 | SPC00005 SPC10019 |
| Bacteroides_vulgatus | Bacteroides_ovatus | SPC00005 SPC10030 |
| Bacteroides_vulgatus | Parabacteroides_merdae | SPC00005 SPC10048 |
| Bacteroides_vulgatus | Bacteroides_vulgatus | SPC00005 SPC10081 |
| Bacteroides_vulgatus | Collinsella_aerofaciens | SPC00005 SPC10097 |
| Bacteroides_vulgatus | Escherichia_coli | SPC00005 SPC10110 |
| Bacteroides_vulgatus | Ruminococcus_obeum | SPC00005 SPC10197 |
| Bacteroides_vulgatus | Bacteroides_caccae | SPC00005 SPC10211 |
| Bacteroides_vulgatus | Bacteroides_eggerthii | SPC00005 SPC10213 |
| Bacteroides_vulgatus | Ruminococcus_torques | SPC00005 SPC10233 |
| Bacteroides_vulgatus | Clostridium_hathewayi | SPC00005 SPC10243 |
| Bacteroides_vulgatus | Bifidobacterium_pseudocatenulatum | SPC00005 SPC10298 |
| Bacteroides_vulgatus | Bifidobacterium_adolescentis | SPC00005 SPC10301 |
| Bacteroides_vulgatus | Coprococcus_comes | SPC00005 SPC10304 |
| Bacteroides_vulgatus | Clostridium_symbiosum | SPC00005 SPC10355 |
| Bacteroides_vulgatus | Eubacterium_rectale | SPC00005 SPC10363 |
| Bacteroides_vulgatus | Faecalibacterium_prausnitzii | SPC00005 SPC10386 |
| Bacteroides_vulgatus | Odoribacter_splanchnicus | SPC00005 SPC10388 |
| Bacteroides_vulgatus | Lachnospiraceae_bacterium_5_1_57FAA | SPC00005 SPC10390 |
| Bacteroides_vulgatus | Blautia_schinkii | SPC00005 SPC10403 |
| Bacteroides_vulgatus | Alistipes_shahii | SPC00005 SPC10414 |
| Bacteroides_vulgatus | Blautia_producta | SPC00005 SPC10415 |
| Bacteroides_sp_1_1_6 | Bacteroides_sp_1_1_6 | SPC00006 SPC00006 |
| Bacteroides_sp_1_1_6 | Bacteroides_sp_3_1_23 | SPC00006 SPC00007 |
| Bacteroides_sp_1_1_6 | Enterococcus_faecalis | SPC00006 SPC00008 |
| Bacteroides_sp_1_1_6 | Coprobacillus_sp_D7 | SPC00006 SPC00009 |
| Bacteroides_sp_1_1_6 | Streptococcus_thermophilus | SPC00006 SPC00015 |
| Bacteroides_sp_1_1_6 | Dorea_formicigenerans | SPC00006 SPC00018 |
| Bacteroides_sp_1_1_6 | Blautia_producta | SPC00006 SPC00021 |
| Bacteroides_sp_1_1_6 | Eubacterium_eligens | SPC00006 SPC00022 |
| Bacteroides_sp_1_1_6 | Clostridium_nexile | SPC00006 SPC00026 |
| Bacteroides_sp_1_1_6 | Clostridium_sp_HGF2 | SPC00006 SPC00027 |
| Bacteroides_sp_1_1_6 | Faecalibacterium_prausnitzii | SPC00006 SPC00054 |
| Bacteroides_sp_1_1_6 | Odoribacter_splanchnicus | SPC00006 SPC00056 |
| Bacteroides_sp_1_1_6 | Dorea_longicatena | SPC00006 SPC00057 |
| Bacteroides_sp_1_1_6 | Roseburia_intestinalis | SPC00006 SPC00061 |
| Bacteroides_sp_1_1_6 | Coprococcus_catus | SPC00006 SPC00080 |
| Bacteroides_sp_1_1_6 | Erysipelotrichaceae_bacterium_3_1_53 | SPC00006 SPC10001 |
| Bacteroides_sp_1_1_6 | Bacteroides_sp_D20 | SPC00006 SPC10019 |
| Bacteroides_sp_1_1_6 | Bacteroides_ovatus | SPC00006 SPC10030 |
| Bacteroides_sp_1_1_6 | Parabacteroides_merdae | SPC00006 SPC10048 |
| Bacteroides_sp_1_1_6 | Bacteroides_vulgatus | SPC00006 SPC10081 |
| Bacteroides_sp_1_1_6 | Collinsella_aerofaciens | SPC00006 SPC10097 |
| Bacteroides_sp_1_1_6 | Escherichia_coli | SPC00006 SPC10110 |

TABLE 4a-continued

| | | |
|---|---|---|
| Bacteroides_sp_1_1_6 | Ruminococcus_obeum | SPC00006 SPC10197 |
| Bacteroides_sp_1_1_6 | Bacteroides_caccae | SPC00006 SPC10211 |
| Bacteroides_sp_1_1_6 | Bacteroides_eggerthii | SPC00006 SPC10213 |
| Bacteroides_sp_1_1_6 | Ruminococcus_torques | SPC00006 SPC10233 |
| Bacteroides_sp_1_1_6 | Clostridium_hathewayi | SPC00006 SPC10243 |
| Bacteroides_sp_1_1_6 | Bifidobacterium_pseudocatenulatum | SPC00006 SPC10298 |
| Bacteroides_sp_1_1_6 | Bifidobacterium_adolescentis | SPC00006 SPC10301 |
| Bacteroides_sp_1_1_6 | Coprococcus_comes | SPC00006 SPC10304 |
| Bacteroides_sp_1_1_6 | Clostridium_symbiosum | SPC00006 SPC10355 |
| Bacteroides_sp_1_1_6 | Eubacterium_rectale | SPC00006 SPC10363 |
| Bacteroides_sp_1_1_6 | Faecalibacterium_prausnitzii | SPC00006 SPC10386 |
| Bacteroides_sp_1_1_6 | Odoribacter_splanchnicus | SPC00006 SPC10388 |
| Bacteroides_sp_1_1_6 | Lachnospiraceae_bacterium_5_1_57FAA | SPC00006 SPC10390 |
| Bacteroides_sp_1_1_6 | Blautia_schinkii | SPC00006 SPC10403 |
| Bacteroides_sp_1_1_6 | Alistipes_shahii | SPC00006 SPC10414 |
| Bacteroides_sp_1_1_6 | Blautia_producta | SPC00006 SPC10415 |
| Bacteroides_sp_3_1_23 | Bacteroides_sp_3_1_23 | SPC00007 SPC00007 |
| Bacteroides_sp_3_1_23 | Enterococcus_faecalis | SPC00007 SPC00008 |
| Bacteroides_sp_3_1_23 | Coprobacillus_sp_D7 | SPC00007 SPC00009 |
| Bacteroides_sp_3_1_23 | Streptococcus_thermophilus | SPC00007 SPC00015 |
| Bacteroides_sp_3_1_23 | Dorea_formicigenerans | SPC00007 SPC00018 |
| Bacteroides_sp_3_1_23 | Blautia_producta | SPC00007 SPC00021 |
| Bacteroides_sp_3_1_23 | Eubacterium_eligens | SPC00007 SPC00022 |
| Bacteroides_sp_3_1_23 | Clostridium_nexile | SPC00007 SPC00026 |
| Bacteroides_sp_3_1_23 | Clostridium_sp_HGF2 | SPC00007 SPC00027 |
| Bacteroides_sp_3_1_23 | Faecalibacterium_prausnitzii | SPC00007 SPC00054 |
| Bacteroides_sp_3_1_23 | Odoribacter_splanchnicus | SPC00007 SPC00056 |
| Bacteroides_sp_3_1_23 | Dorea_longicatena | SPC00007 SPC00057 |
| Bacteroides_sp_3_1_23 | Roseburia_intestinalis | SPC00007 SPC00061 |
| Bacteroides_sp_3_1_23 | Coprococcus_catus | SPC00007 SPC00080 |
| Bacteroides_sp_3_1_23 | Erysipelotrichaceae_bacterium_3_1_53 | SPC00007 SPC10001 |
| Bacteroides_sp_3_1_23 | Bacteroides_sp_D20 | SPC00007 SPC10019 |
| Bacteroides_sp_3_1_23 | Bacteroides_ovatus | SPC00007 SPC10030 |
| Bacteroides_sp_3_1_23 | Parabacteroides_merdae | SPC00007 SPC10048 |
| Bacteroides_sp_3_1_23 | Bacteroides_vulgatus | SPC00007 SPC10081 |
| Bacteroides_sp_3_1_23 | Collinsella_aerofaciens | SPC00007 SPC10097 |
| Bacteroides_sp_3_1_23 | Escherichia_coli | SPC00007 SPC10110 |
| Bacteroides_sp_3_1_23 | Ruminococcus_obeum | SPC00007 SPC10197 |
| Bacteroides_sp_3_1_23 | Bacteroides_caccae | SPC00007 SPC10211 |
| Bacteroides_sp_3_1_23 | Bacteroides_eggerthii | SPC00007 SPC10213 |
| Bacteroides_sp_3_1_23 | Ruminococcus_torques | SPC00007 SPC10233 |
| Bacteroides_sp_3_1_23 | Clostridium_hathewayi | SPC00007 SPC10243 |
| Bacteroides_sp_3_1_23 | Bifidobacterium_pseudocatenulatum | SPC00007 SPC10298 |
| Bacteroides_sp_3_1_23 | Bifidobacterium_adolescentis | SPC00007 SPC10301 |
| Bacteroides_sp_3_1_23 | Coprococcus_comes | SPC00007 SPC10304 |
| Bacteroides_sp_3_1_23 | Clostridium_symbiosum | SPC00007 SPC10355 |
| Bacteroides_sp_3_1_23 | Eubacterium_rectale | SPC00007 SPC10363 |
| Bacteroides_sp_3_1_23 | Faecalibacterium_prausnitzii | SPC00007 SPC10386 |
| Bacteroides_sp_3_1_23 | Odoribacter_splanchnicus | SPC00007 SPC10388 |
| Bacteroides_sp_3_1_23 | Lachnospiraceae_bacterium_5_1_57FAA | SPC00007 SPC10390 |
| Bacteroides_sp_3_1_23 | Blautia_schinkii | SPC00007 SPC10403 |
| Bacteroides_sp_3_1_23 | Alistipes_shahii | SPC00007 SPC10414 |
| Bacteroides_sp_3_1_23 | Blautia_producta | SPC00007 SPC10415 |

TABLE 4a-continued

| | | | |
|---|---|---|---|
| Enterococcus_faecalis | Enterococcus_faecalis | SPC00008 | SPC00008 |
| Enterococcus_faecalis | Coprobacillus_sp_D7 | SPC00008 | SPC00009 |
| Enterococcus_faecalis | Streptococcus_thermophilus | SPC00008 | SPC00015 |
| Enterococcus_faecalis | Dorea_formicigenerans | SPC00008 | SPC00018 |
| Enterococcus_faecalis | Blautia_producta | SPC00008 | SPC00021 |
| Enterococcus_faecalis | Eubacterium_eligens | SPC00008 | SPC00022 |
| Enterococcus_faecalis | Clostridium_nexile | SPC00008 | SPC00026 |
| Enterococcus_faecalis | Clostridium_sp_HGF2 | SPC00008 | SPC00027 |
| Enterococcus_faecalis | Faecalibacterium_prausnitzii | SPC00008 | SPC00054 |
| Enterococcus_faecalis | Odoribacter_splanchnicus | SPC00008 | SPC00056 |
| Enterococcus_faecalis | Dorea_longicatena | SPC00008 | SPC00057 |
| Enterococcus_faecalis | Roseburia_intestinalis | SPC00008 | SPC00061 |
| Enterococcus_faecalis | Coprococcus_catus | SPC00008 | SPC00080 |
| Enterococcus_faecalis | Erysipelotrichaceae_bacterium_3_1_53 | SPC00008 | SPC10001 |
| Enterococcus_faecalis | Bacteroides_sp_D20 | SPC00008 | SPC10019 |
| Enterococcus_faecalis | Bacteroides_ovatus | SPC00008 | SPC10030 |
| Enterococcus_faecalis | Parabacteroides_merdae | SPC00008 | SPC10048 |
| Enterococcus_faecalis | Bacteroides_vulgatus | SPC00008 | SPC10081 |
| Enterococcus_faecalis | Collinsella_aerofaciens | SPC00008 | SPC10097 |
| Enterococcus_faecalis | Escherichia_coli | SPC00008 | SPC10110 |
| Enterococcus_faecalis | Ruminococcus_obeum | SPC00008 | SPC10197 |
| Enterococcus_faecalis | Bacteroides_caccae | SPC00008 | SPC10211 |
| Enterococcus_faecalis | Bacteroides_eggerthii | SPC00008 | SPC10213 |
| Enterococcus_faecalis | Ruminococcus_torques | SPC00008 | SPC10233 |
| Enterococcus_faecalis | Clostridium_hathewayi | SPC00008 | SPC10243 |
| Enterococcus_faecalis | Bifidobacterium_pseudocatenulatum | SPC00008 | SPC10298 |
| Enterococcus_faecalis | Bifidobacterium_adolescentis | SPC00008 | SPC10301 |
| Enterococcus_faecalis | Coprococcus_comes | SPC00008 | SPC10304 |
| Enterococcus_faecalis | Clostridium_symbiosum | SPC00008 | SPC10355 |
| Enterococcus_faecalis | Eubacterium_rectale | SPC00008 | SPC10363 |
| Enterococcus_faecalis | Faecalibacterium_prausnitzii | SPC00008 | SPC10386 |
| Enterococcus_faecalis | Odoribacter_splanchnicus | SPC00008 | SPC10388 |
| Enterococcus_faecalis | Lachnospiraceae_bacterium_5_1_57FAA | SPC00008 | SPC10390 |
| Enterococcus_faecalis | Blautia_schinkii | SPC00008 | SPC10403 |
| Enterococcus_faecalis | Alistipes_shahii | SPC00008 | SPC10414 |
| Enterococcus_faecalis | Blautia_producta | SPC00008 | SPC10415 |
| Coprobacillus_sp_D7 | Coprobacillus_sp_D7 | SPC00009 | SPC00009 |
| Coprobacillus_sp_D7 | Streptococcus_thermophilus | SPC00009 | SPC00015 |
| Coprobacillus_sp_D7 | Dorea_formicigenerans | SPC00009 | SPC00018 |
| Coprobacillus_sp_D7 | Blautia_producta | SPC00009 | SPC00021 |
| Coprobacillus_sp_D7 | Eubacterium_eligens | SPC00009 | SPC00022 |
| Coprobacillus_sp_D7 | Clostridium_nexile | SPC00009 | SPC00026 |
| Coprobacillus_sp_D7 | Clostridium_sp_HGF2 | SPC00009 | SPC00027 |
| Coprobacillus_sp_D7 | Faecalibacterium_prausnitzii | SPC00009 | SPC00054 |
| Coprobacillus_sp_D7 | Odoribacter_splanchnicus | SPC00009 | SPC00056 |
| Coprobacillus_sp_D7 | Dorea_longicatena | SPC00009 | SPC00057 |
| Coprobacillus_sp_D7 | Roseburia_intestinalis | SPC00009 | SPC00061 |
| Coprobacillus_sp_D7 | Coprococcus_catus | SPC00009 | SPC00080 |
| Coprobacillus_sp_D7 | Erysipelotrichaceae_bacterium_3_1_53 | SPC00009 | SPC10001 |
| Coprobacillus_sp_D7 | Bacteroides_sp_D20 | SPC00009 | SPC10019 |
| Coprobacillus_sp_D7 | Bacteroides_ovatus | SPC00009 | SPC10030 |
| Coprobacillus_sp_D7 | Parabacteroides_merdae | SPC00009 | SPC10048 |
| Coprobacillus_sp_D7 | Bacteroides_vulgatus | SPC00009 | SPC10081 |

TABLE 4a-continued

| | | | |
|---|---|---|---|
| Coprobacillus_sp_D7 | Collinsella_aerofaciens | SPC00009 | SPC10097 |
| Coprobacillus_sp_D7 | Escherichia_coli | SPC00009 | SPC10110 |
| Coprobacillus_sp_D7 | Ruminococcus_obeum | SPC00009 | SPC10197 |
| Coprobacillus_sp_D7 | Bacteroides_caccae | SPC00009 | SPC10211 |
| Coprobacillus_sp_D7 | Bacteroides_eggerthii | SPC00009 | SPC10213 |
| Coprobacillus_sp_D7 | Ruminococcus_torques | SPC00009 | SPC10233 |
| Coprobacillus_sp_D7 | Clostridium_hathewayi | SPC00009 | SPC10243 |
| Coprobacillus_sp_D7 | Bifidobacterium_pseudocatenulatum | SPC00009 | SPC10298 |
| Coprobacillus_sp_D7 | Bifidobacterium_adolescentis | SPC00009 | SPC10301 |
| Coprobacillus_sp_D7 | Coprococcus_comes | SPC00009 | SPC10304 |
| Coprobacillus_sp_D7 | Clostridium_symbiosum | SPC00009 | SPC10355 |
| Coprobacillus_sp_D7 | Eubacterium_rectale | SPC00009 | SPC10363 |
| Coprobacillus_sp_D7 | Faecalibacterium_prausnitzii | SPC00009 | SPC10386 |
| Coprobacillus_sp_D7 | Odoribacter_splanchnicus | SPC00009 | SPC10388 |
| Coprobacillus_sp_D7 | Lachnospiraceae_bacterium_5_1_57FAA | SPC00009 | SPC10390 |
| Coprobacillus_sp_D7 | Blautia_schinkii | SPC00009 | SPC10403 |
| Coprobacillus_sp_D7 | Alistipes_shahii | SPC00009 | SPC10414 |
| Coprobacillus_sp_D7 | Blautia_producta | SPC00009 | SPC10415 |
| Streptococcus_thermophilus | Streptococcus_thermophilus | SPC00015 | SPC00015 |
| Streptococcus_thermophilus | Dorea_formicigenerans | SPC00015 | SPC00018 |
| Streptococcus_thermophilus | Blautia_producta | SPC00015 | SPC00021 |
| Streptococcus_thermophilus | Eubacterium_eligens | SPC00015 | SPC00022 |
| Streptococcus_thermophilus | Clostridium_nexile | SPC00015 | SPC00026 |
| Streptococcus_thermophilus | Clostridium_sp_HGF2 | SPC00015 | SPC00027 |
| Streptococcus_thermophilus | Faecalibacterium_prausnitzii | SPC00015 | SPC00054 |
| Streptococcus_thermophilus | Odoribacter_splanchnicus | SPC00015 | SPC00056 |
| Streptococcus_thermophilus | Dorea_longicatena | SPC00015 | SPC00057 |
| Streptococcus_thermophilus | Roseburia_intestinalis | SPC00015 | SPC00061 |
| Streptococcus_thermophilus | Coprococcus_catus | SPC00015 | SPC00080 |
| Streptococcus_thermophilus | Erysipelotrichaceae_bacterium_3_1_53 | SPC00015 | SPC10001 |
| Streptococcus_thermophilus | Bacteroides_sp_D20 | SPC00015 | SPC10019 |
| Streptococcus_thermophilus | Bacteroides_ovatus | SPC00015 | SPC10030 |
| Streptococcus_thermophilus | Parabacteroides_merdae | SPC00015 | SPC10048 |
| Streptococcus_thermophilus | Bacteroides_vulgatus | SPC00015 | SPC10081 |
| Streptococcus_thermophilus | Collinsella_aerofaciens | SPC00015 | SPC10097 |
| Streptococcus_thermophilus | Escherichia_coli | SPC00015 | SPC10110 |
| Streptococcus_thermophilus | Ruminococcus_obeum | SPC00015 | SPC10197 |
| Streptococcus_thermophilus | Bacteroides_caccae | SPC00015 | SPC10211 |
| Streptococcus_thermophilus | Bacteroides_eggerthii | SPC00015 | SPC10213 |
| Streptococcus_thermophilus | Ruminococcus_torques | SPC00015 | SPC10233 |
| Streptococcus_thermophilus | Clostridium_hathewayi | SPC00015 | SPC10243 |
| Streptococcus_thermophilus | Bifidobacterium_pseudocatenulatum | SPC00015 | SPC10298 |
| Streptococcus_thermophilus | Bifidobacterium_adolescentis | SPC00015 | SPC10301 |
| Streptococcus_thermophilus | Coprococcus_comes | SPC00015 | SPC10304 |
| Streptococcus_thermophilus | Clostridium_symbiosum | SPC00015 | SPC10355 |
| Streptococcus_thermophilus | Eubacterium_rectale | SPC00015 | SPC10363 |
| Streptococcus_thermophilus | Faecalibacterium_prausnitzii | SPC00015 | SPC10386 |
| Streptococcus_thermophilus | Odoribacter_splanchnicus | SPC00015 | SPC10388 |
| Streptococcus_thermophilus | Lachnospiraceae_bacterium_5_1_57FAA | SPC00015 | SPC10390 |
| Streptococcus_thermophilus | Blautia_schinkii | SPC00015 | SPC10403 |
| Streptococcus_thermophilus | Alistipes_shahii | SPC00015 | SPC10414 |
| Streptococcus_thermophilus | Blautia_producta | SPC00015 | SPC10415 |
| Dorea_formicigenerans | Dorea_formicigenerans | SPC00018 | SPC00018 |

TABLE 4a-continued

| | | | |
|---|---|---|---|
| Dorea_formicigenerans | Blautia_producta | SPC00018 | SPC00021 |
| Dorea_formicigenerans | Eubacterium_eligens | SPC00018 | SPC00022 |
| Dorea_formicigenerans | Clostridium_nexile | SPC00018 | SPC00026 |
| Dorea_formicigenerans | Clostridium_sp_HGF2 | SPC00018 | SPC00027 |
| Dorea_formicigenerans | Faecalibacterium_prausnitzii | SPC00018 | SPC00054 |
| Dorea_formicigenerans | Odoribacter_splanchnicus | SPC00018 | SPC00056 |
| Dorea_formicigenerans | Dorea_longicatena | SPC00018 | SPC00057 |
| Dorea_formicigenerans | Roseburia_intestinalis | SPC00018 | SPC00061 |
| Dorea_formicigenerans | Coprococcus_catus | SPC00018 | SPC00080 |
| Dorea_formicigenerans | Erysipelotrichaceae_bacterium_3_1_53 | SPC00018 | SPC10001 |
| Dorea_formicigenerans | Bacteroides_sp_D20 | SPC00018 | SPC10019 |
| Dorea_formicigenerans | Bacteroides_ovatus | SPC00018 | SPC10030 |
| Dorea_formicigenerans | Parabacteroides_merdae | SPC00018 | SPC10048 |
| Dorea_formicigenerans | Bacteroides_vulgatus | SPC00018 | SPC10081 |
| Dorea_formicigenerans | Collinsella_aerofaciens | SPC00018 | SPC10097 |
| Dorea_formicigenerans | Escherichia_coli | SPC00018 | SPC10110 |
| Dorea_formicigenerans | Ruminococcus_obeum | SPC00018 | SPC10197 |
| Dorea_formicigenerans | Bacteroides_caccae | SPC00018 | SPC10211 |
| Dorea_formicigenerans | Bacteroides_eggerthii | SPC00018 | SPC10213 |
| Dorea_formicigenerans | Ruminococcus_torques | SPC00018 | SPC10233 |
| Dorea_formicigenerans | Clostridium_hathewayi | SPC00018 | SPC10243 |
| Dorea_formicigenerans | Bifidobacterium_pseudocatenulatum | SPC00018 | SPC10298 |
| Dorea_formicigenerans | Bifidobacterium_adolescentis | SPC00018 | SPC10301 |
| Dorea_formicigenerans | Coprococcus_comes | SPC00018 | SPC10304 |
| Dorea_formicigenerans | Clostridium_symbiosum | SPC00018 | SPC10355 |
| Dorea_formicigenerans | Eubacterium_rectale | SPC00018 | SPC10363 |
| Dorea_formicigenerans | Faecalibacterium_prausnitzii | SPC00018 | SPC10386 |
| Dorea_formicigenerans | Odoribacter_splanchnicus | SPC00018 | SPC10388 |
| Dorea_formicigenerans | Lachnospiraceae_bacterium_5_1_57FAA | SPC00018 | SPC10390 |
| Dorea_formicigenerans | Blautia_schinkii | SPC00018 | SPC10403 |
| Dorea_formicigenerans | Alistipes_shahii | SPC00018 | SPC10414 |
| Dorea_formicigenerans | Blautia_producta | SPC00018 | SPC10415 |
| Blautia_producta | Blautia_producta | SPC00021 | SPC00021 |
| Blautia_producta | Eubacterium_eligens | SPC00021 | SPC00022 |
| Blautia_producta | Clostridium_nexile | SPC00021 | SPC00026 |
| Blautia_producta | Clostridium_sp_HGF2 | SPC00021 | SPC00027 |
| Blautia_producta | Faecalibacterium_prausnitzii | SPC00021 | SPC00054 |
| Blautia_producta | Odoribacter_splanchnicus | SPC00021 | SPC00056 |
| Blautia_producta | Dorea_longicatena | SPC00021 | SPC00057 |
| Blautia_producta | Roseburia_intestinalis | SPC00021 | SPC00061 |
| Blautia_producta | Coprococcus_catus | SPC00021 | SPC00080 |
| Blautia_producta | Erysipelotrichaceae_bacterium_3_1_53 | SPC00021 | SPC10001 |
| Blautia_producta | Bacteroides_sp_D20 | SPC00021 | SPC10019 |
| Blautia_producta | Bacteroides_ovatus | SPC00021 | SPC10030 |
| Blautia_producta | Parabacteroides_merdae | SPC00021 | SPC10048 |
| Blautia_producta | Bacteroides_vulgatus | SPC00021 | SPC10081 |
| Blautia_producta | Collinsella_aerofaciens | SPC00021 | SPC10097 |
| Blautia_producta | Escherichia_coli | SPC00021 | SPC10110 |
| Blautia_producta | Ruminococcus_obeum | SPC00021 | SPC10197 |
| Blautia_producta | Bacteroides_caccae | SPC00021 | SPC10211 |
| Blautia_producta | Bacteroides_eggerthii | SPC00021 | SPC10213 |
| Blautia_producta | Ruminococcus_torques | SPC00021 | SPC10233 |
| Blautia_producta | Clostridium_hathewayi | SPC00021 | SPC10243 |

TABLE 4a-continued

| | | |
|---|---|---|
| Blautia_producta | Bifidobacterium_pseudocatenulatum | SPC00021 SPC10298 |
| Blautia_producta | Bifidobacterium_adolescentis | SPC00021 SPC10301 |
| Blautia_producta | Coprococcus_comes | SPC00021 SPC10304 |
| Blautia_producta | Clostridium_symbiosum | SPC00021 SPC10355 |
| Blautia_producta | Eubacterium_rectale | SPC00021 SPC10363 |
| Blautia_producta | Faecalibacterium_prausnitzii | SPC00021 SPC10386 |
| Blautia_producta | Odoribacter_splanchnicus | SPC00021 SPC10388 |
| Blautia_producta | Lachnospiraceae_bacterium_5_1_57FAA | SPC00021 SPC10390 |
| Blautia_producta | Blautia_schinkii | SPC00021 SPC10403 |
| Blautia_producta | Alistipes_shahii | SPC00021 SPC10414 |
| Blautia_producta | Blautia_producta | SPC00021 SPC10415 |
| Eubacterium_eligens | Eubacterium_eligens | SPC00022 SPC00022 |
| Eubacterium_eligens | Clostridium_nexile | SPC00022 SPC00026 |
| Eubacterium_eligens | Clostridium_sp_HGF2 | SPC00022 SPC00027 |
| Eubacterium_eligens | Faecalibacterium_prausnitzii | SPC00022 SPC00054 |
| Eubacterium_eligens | Odoribacter_splanchnicus | SPC00022 SPC00056 |
| Eubacterium_eligens | Dorea_longicatena | SPC00022 SPC00057 |
| Eubacterium_eligens | Roseburia_intestinalis | SPC00022 SPC00061 |
| Eubacterium_eligens | Coprococcus_catus | SPC00022 SPC00080 |
| Eubacterium_eligens | Erysipelotrichaceae_bacterium_3_1_53 | SPC00022 SPC10001 |
| Eubacterium_eligens | Bacteroides_sp_D20 | SPC00022 SPC10019 |
| Eubacterium_eligens | Bacteroides_ovatus | SPC00022 SPC10030 |
| Eubacterium_eligens | Parabacteroides_merdae | SPC00022 SPC10048 |
| Eubacterium_eligens | Bacteroides_vulgatus | SPC00022 SPC10081 |
| Eubacterium_eligens | Collinsella_aerofaciens | SPC00022 SPC10097 |
| Eubacterium_eligens | Escherichia_coli | SPC00022 SPC10110 |
| Eubacterium_eligens | Ruminococcus_obeum | SPC00022 SPC10197 |
| Eubacterium_eligens | Bacteroides_caccae | SPC00022 SPC10211 |
| Eubacterium_eligens | Bacteroides_eggerthii | SPC00022 SPC10213 |
| Eubacterium_eligens | Ruminococcus_torques | SPC00022 SPC10233 |
| Eubacterium_eligens | Clostridium_hathewayi | SPC00022 SPC10243 |
| Eubacterium_eligens | Bifidobacterium_pseudocatenulatum | SPC00022 SPC10298 |
| Eubacterium_eligens | Bifidobacterium_adolescentis | SPC00022 SPC10301 |
| Eubacterium_eligens | Coprococcus_comes | SPC00022 SPC10304 |
| Eubacterium_eligens | Clostridium_symbiosum | SPC00022 SPC10355 |
| Eubacterium_eligens | Eubacterium_rectale | SPC00022 SPC10363 |
| Eubacterium_eligens | Faecalibacterium_prausnitzii | SPC00022 SPC10386 |
| Eubacterium_eligens | Odoribacter_splanchnicus | SPC00022 SPC10388 |
| Eubacterium_eligens | Lachnospiraceae_bacterium_5_1_57FAA | SPC00022 SPC10390 |
| Eubacterium_eligens | Blautia_schinkii | SPC00022 SPC10403 |
| Eubacterium_eligens | Alistipes_shahii | SPC00022 SPC10414 |
| Eubacterium_eligens | Blautia_producta | SPC00022 SPC10415 |
| Clostridium_nexile | Clostridium_nexile | SPC00026 SPC00026 |
| Clostridium_nexile | Clostridium_sp_HGF2 | SPC00026 SPC00027 |
| Clostridium_nexile | Faecalibacterium_prausnitzii | SPC00026 SPC00054 |
| Clostridium_nexile | Odoribacter_splanchnicus | SPC00026 SPC00056 |
| Clostridium_nexile | Dorea_longicatena | SPC00026 SPC00057 |
| Clostridium_nexile | Roseburia_intestinalis | SPC00026 SPC00061 |
| Clostridium_nexile | Coprococcus_catus | SPC00026 SPC00080 |
| Clostridium_nexile | Erysipelotrichaceae_bacterium_3_1_53 | SPC00026 SPC10001 |
| Clostridium_nexile | Bacteroides_sp_D20 | SPC00026 SPC10019 |
| Clostridium_nexile | Bacteroides_ovatus | SPC00026 SPC10030 |
| Clostridium_nexile | Parabacteroides_merdae | SPC00026 SPC10048 |

TABLE 4a-continued

| | | |
|---|---|---|
| Clostridium_nexile | Bacteroides_vulgatus | SPC10081 |
| Clostridium_nexile | Collinsella_aerofaciens | SPC10097 |
| Clostridium_nexile | Escherichia_coli | SPC10110 |
| Clostridium_nexile | Ruminococcus_obeum | SPC10197 |
| Clostridium_nexile | Bacteroides_caccae | SPC10211 |
| Clostridium_nexile | Bacteroides_eggerthii | SPC10213 |
| Clostridium_nexile | Ruminococcus_torques | SPC10233 |
| Clostridium_nexile | Clostridium_hathewayi | SPC10243 |
| Clostridium_nexile | Bifidobacterium_pseudocatenulatum | SPC10298 |
| Clostridium_nexile | Bifidobacterium_adolescentis | SPC10301 |
| Clostridium_nexile | Coprococcus_comes | SPC10304 |
| Clostridium_nexile | Clostridium_symbiosum | SPC10355 |
| Clostridium_nexile | Eubacterium_rectale | SPC10363 |
| Clostridium_nexile | Faecalibacterium_prausnitzii | SPC10386 |
| Clostridium_nexile | Odoribacter_splanchnicus | SPC10388 |
| Clostridium_nexile | Dorea_longicatena | SPC10390 |
| Clostridium_nexile | Lachnospiraceae_bacterium_5_1_57FAA | SPC10403 |
| Clostridium_nexile | Blautia_schinkii | SPC10414 |
| Clostridium_nexile | Alistipes_shahii | SPC10415 |
| Clostridium_nexile | Blautia_producta | SPC00026 |
| Clostridium_sp_HGF2 | Clostridium_sp_HGF2 | SPC00027 |
| Clostridium_sp_HGF2 | Faecalibacterium_prausnitzii | SPC00054 |
| Clostridium_sp_HGF2 | Odoribacter_splanchnicus | SPC00056 |
| Clostridium_sp_HGF2 | Dorea_longicatena | SPC00057 |
| Clostridium_sp_HGF2 | Roseburia_intestinalis | SPC00061 |
| Clostridium_sp_HGF2 | Coprococcus_catus | SPC00080 |
| Clostridium_sp_HGF2 | Erysipelotrichaceae_bacterium_3_1_53 | SPC10001 |
| Clostridium_sp_HGF2 | Bacteroides_sp_D20 | SPC10019 |
| Clostridium_sp_HGF2 | Bacteroides_ovatus | SPC10030 |
| Clostridium_sp_HGF2 | Parabacteroides_merdae | SPC10048 |
| Clostridium_sp_HGF2 | Bacteroides_vulgatus | SPC10081 |
| Clostridium_sp_HGF2 | Collinsella_aerofaciens | SPC10097 |
| Clostridium_sp_HGF2 | Escherichia_coli | SPC10110 |
| Clostridium_sp_HGF2 | Ruminococcus_obeum | SPC10197 |
| Clostridium_sp_HGF2 | Bacteroides_caccae | SPC10211 |
| Clostridium_sp_HGF2 | Bacteroides_eggerthii | SPC10213 |
| Clostridium_sp_HGF2 | Ruminococcus_torques | SPC10233 |
| Clostridium_sp_HGF2 | Clostridium_hathewayi | SPC10243 |
| Clostridium_sp_HGF2 | Bifidobacterium_pseudocatenulatum | SPC10298 |
| Clostridium_sp_HGF2 | Bifidobacterium_adolescentis | SPC10301 |
| Clostridium_sp_HGF2 | Coprococcus_comes | SPC10304 |
| Clostridium_sp_HGF2 | Clostridium_symbiosum | SPC10355 |
| Clostridium_sp_HGF2 | Eubacterium_rectale | SPC10363 |
| Clostridium_sp_HGF2 | Faecalibacterium_prausnitzii | SPC10386 |
| Clostridium_sp_HGF2 | Odoribacter_splanchnicus | SPC10388 |
| Clostridium_sp_HGF2 | Dorea_longicatena | SPC10390 |
| Clostridium_sp_HGF2 | Lachnospiraceae_bacterium_5_1_57FAA | SPC10403 |
| Clostridium_sp_HGF2 | Blautia_schinkii | SPC10414 |
| Clostridium_sp_HGF2 | Alistipes_shahii | SPC10415 |
| Clostridium_sp_HGF2 | Blautia_producta | SPC00027 |
| Faecalibacterium_prausnitzii | Faecalibacterium_prausnitzii | SPC00054 |
| Faecalibacterium_prausnitzii | Odoribacter_splanchnicus | SPC00056 |
| Faecalibacterium_prausnitzii | Dorea_longicatena | SPC00057 |
| Faecalibacterium_prausnitzii | Roseburia_intestinalis | SPC00061 |
| Faecalibacterium_prausnitzii | Coprococcus_catus | SPC00080 |

TABLE 4a-continued

| | | | |
|---|---|---|---|
| Faecalibacterium_prausnitzii | Erysipelotrichaceae_bacterium_3_1_53 | SPC00054 | SPC10001 |
| Faecalibacterium_prausnitzii | Bacteroides_sp_D20 | SPC00054 | SPC10019 |
| Faecalibacterium_prausnitzii | Bacteroides_ovatus | SPC00054 | SPC10030 |
| Faecalibacterium_prausnitzii | Parabacteroides_merdae | SPC00054 | SPC10048 |
| Faecalibacterium_prausnitzii | Bacteroides_vulgatus | SPC00054 | SPC10081 |
| Faecalibacterium_prausnitzii | Collinsella_aerofaciens | SPC00054 | SPC10097 |
| Faecalibacterium_prausnitzii | Escherichia_coli | SPC00054 | SPC10110 |
| Faecalibacterium_prausnitzii | Ruminococcus_obeum | SPC00054 | SPC10197 |
| Faecalibacterium_prausnitzii | Bacteroides_caccae | SPC00054 | SPC10211 |
| Faecalibacterium_prausnitzii | Bacteroides_eggerthii | SPC00054 | SPC10213 |
| Faecalibacterium_prausnitzii | Ruminococcus_torques | SPC00054 | SPC10233 |
| Faecalibacterium_prausnitzii | Clostridium_hathewayi | SPC00054 | SPC10243 |
| Faecalibacterium_prausnitzii | Bifidobacterium_pseudocatenulatum | SPC00054 | SPC10298 |
| Faecalibacterium_prausnitzii | Bifidobacterium_adolescentis | SPC00054 | SPC10301 |
| Faecalibacterium_prausnitzii | Coprococcus_comes | SPC00054 | SPC10304 |
| Faecalibacterium_prausnitzii | Clostridium_symbiosum | SPC00054 | SPC10355 |
| Faecalibacterium_prausnitzii | Eubacterium_rectale | SPC00054 | SPC10363 |
| Faecalibacterium_prausnitzii | Faecalibacterium_prausnitzii | SPC00054 | SPC10386 |
| Faecalibacterium_prausnitzii | Odoribacter_splanchnicus | SPC00054 | SPC10388 |
| Faecalibacterium_prausnitzii | Lachnospiraceae_bacterium_5_1_57FAA | SPC00054 | SPC10390 |
| Faecalibacterium_prausnitzii | Blautia_schinkii | SPC00054 | SPC10403 |
| Faecalibacterium_prausnitzii | Alistipes_shahii | SPC00054 | SPC10414 |
| Faecalibacterium_prausnitzii | Blautia_producta | SPC00054 | SPC10415 |
| Odoribacter_splanchnicus | Odoribacter_splanchnicus | SPC00056 | SPC00056 |
| Odoribacter_splanchnicus | Dorea_longicatena | SPC00056 | SPC00057 |
| Odoribacter_splanchnicus | Roseburia_intestinalis | SPC00056 | SPC00061 |
| Odoribacter_splanchnicus | Coprococcus_catus | SPC00056 | SPC00080 |
| Odoribacter_splanchnicus | Erysipelotrichaceae_bacterium_3_1_53 | SPC00056 | SPC10001 |
| Odoribacter_splanchnicus | Bacteroides_sp_D20 | SPC00056 | SPC10019 |
| Odoribacter_splanchnicus | Bacteroides_ovatus | SPC00056 | SPC10030 |
| Odoribacter_splanchnicus | Parabacteroides_merdae | SPC00056 | SPC10048 |
| Odoribacter_splanchnicus | Bacteroides_vulgatus | SPC00056 | SPC10081 |
| Odoribacter_splanchnicus | Collinsella_aerofaciens | SPC00056 | SPC10097 |
| Odoribacter_splanchnicus | Escherichia_coli | SPC00056 | SPC10110 |
| Odoribacter_splanchnicus | Ruminococcus_obeum | SPC00056 | SPC10197 |
| Odoribacter_splanchnicus | Bacteroides_caccae | SPC00056 | SPC10211 |
| Odoribacter_splanchnicus | Bacteroides_eggerthii | SPC00056 | SPC10213 |
| Odoribacter_splanchnicus | Ruminococcus_torques | SPC00056 | SPC10233 |
| Odoribacter_splanchnicus | Clostridium_hathewayi | SPC00056 | SPC10243 |
| Odoribacter_splanchnicus | Bifidobacterium_pseudocatenulatum | SPC00056 | SPC10298 |
| Odoribacter_splanchnicus | Bifidobacterium_adolescentis | SPC00056 | SPC10301 |
| Odoribacter_splanchnicus | Coprococcus_comes | SPC00056 | SPC10304 |
| Odoribacter_splanchnicus | Clostridium_symbiosum | SPC00056 | SPC10355 |
| Odoribacter_splanchnicus | Eubacterium_rectale | SPC00056 | SPC10363 |
| Odoribacter_splanchnicus | Faecalibacterium_prausnitzii | SPC00056 | SPC10386 |
| Odoribacter_splanchnicus | Odoribacter_splanchnicus | SPC00056 | SPC10388 |
| Odoribacter_splanchnicus | Lachnospiraceae_bacterium_5_1_57FAA | SPC00056 | SPC10390 |
| Odoribacter_splanchnicus | Blautia_schinkii | SPC00056 | SPC10403 |
| Odoribacter_splanchnicus | Alistipes_shahii | SPC00056 | SPC10414 |
| Odoribacter_splanchnicus | Blautia_producta | SPC00056 | SPC10415 |
| Dorea_longicatena | Dorea_longicatena | SPC00057 | SPC00057 |
| Dorea_longicatena | Roseburia_intestinalis | SPC00057 | SPC00061 |
| Dorea_longicatena | Coprococcus_catus | SPC00057 | SPC00080 |

TABLE 4a-continued

| | | | |
|---|---|---|---|
| Dorea_longicatena | Erysipelotrichaceae_bacterium_3_1_53 | SPC00057 | SPC10001 |
| Dorea_longicatena | Bacteroides_sp_D20 | SPC00057 | SPC10019 |
| Dorea_longicatena | Bacteroides_ovatus | SPC00057 | SPC10030 |
| Dorea_longicatena | Parabacteroides_merdae | SPC00057 | SPC10048 |
| Dorea_longicatena | Bacteroides_vulgatus | SPC00057 | SPC10081 |
| Dorea_longicatena | Collinsella_aerofaciens | SPC00057 | SPC10097 |
| Dorea_longicatena | Escherichia_coli | SPC00057 | SPC10110 |
| Dorea_longicatena | Ruminococcus_obeum | SPC00057 | SPC10197 |
| Dorea_longicatena | Bacteroides_caccae | SPC00057 | SPC10211 |
| Dorea_longicatena | Bacteroides_eggerthii | SPC00057 | SPC10213 |
| Dorea_longicatena | Ruminococcus_torques | SPC00057 | SPC10233 |
| Dorea_longicatena | Clostridium_hathewayi | SPC00057 | SPC10243 |
| Dorea_longicatena | Bifidobacterium_pseudocatenulatum | SPC00057 | SPC10298 |
| Dorea_longicatena | Bifidobacterium_adolescentis | SPC00057 | SPC10301 |
| Dorea_longicatena | Coprococcus_comes | SPC00057 | SPC10304 |
| Dorea_longicatena | Clostridium_symbiosum | SPC00057 | SPC10355 |
| Dorea_longicatena | Eubacterium_rectale | SPC00057 | SPC10363 |
| Dorea_longicatena | Faecalibacterium_prausnitzii | SPC00057 | SPC10386 |
| Dorea_longicatena | Odoribacter_splanchnicus | SPC00057 | SPC10388 |
| Dorea_longicatena | Lachnospiraceae_bacterium_5_1_57FAA | SPC00057 | SPC10390 |
| Dorea_longicatena | Blautia_schinkii | SPC00057 | SPC10403 |
| Dorea_longicatena | Alistipes_shahii | SPC00057 | SPC10414 |
| Dorea_longicatena | Blautia_producta | SPC00057 | SPC10415 |
| Roseburia_intestinalis | Coprococcus_catus | SPC00061 | SPC00080 |
| Roseburia_intestinalis | Erysipelotrichaceae_bacterium_3_1_53 | SPC00061 | SPC10001 |
| Roseburia_intestinalis | Bacteroides_sp_D20 | SPC00061 | SPC10019 |
| Roseburia_intestinalis | Bacteroides_ovatus | SPC00061 | SPC10030 |
| Roseburia_intestinalis | Parabacteroides_merdae | SPC00061 | SPC10048 |
| Roseburia_intestinalis | Bacteroides_vulgatus | SPC00061 | SPC10081 |
| Roseburia_intestinalis | Collinsella_aerofaciens | SPC00061 | SPC10097 |
| Roseburia_intestinalis | Escherichia_coli | SPC00061 | SPC10110 |
| Roseburia_intestinalis | Ruminococcus_obeum | SPC00061 | SPC10197 |
| Roseburia_intestinalis | Bacteroides_caccae | SPC00061 | SPC10211 |
| Roseburia_intestinalis | Bacteroides_eggerthii | SPC00061 | SPC10213 |
| Roseburia_intestinalis | Ruminococcus_torques | SPC00061 | SPC10233 |
| Roseburia_intestinalis | Clostridium_hathewayi | SPC00061 | SPC10243 |
| Roseburia_intestinalis | Bifidobacterium_pseudocatenulatum | SPC00061 | SPC10298 |
| Roseburia_intestinalis | Bifidobacterium_adolescentis | SPC00061 | SPC10301 |
| Roseburia_intestinalis | Coprococcus_comes | SPC00061 | SPC10304 |
| Roseburia_intestinalis | Clostridium_symbiosum | SPC00061 | SPC10355 |
| Roseburia_intestinalis | Eubacterium_rectale | SPC00061 | SPC10363 |
| Roseburia_intestinalis | Faecalibacterium_prausnitzii | SPC00061 | SPC10386 |
| Roseburia_intestinalis | Odoribacter_splanchnicus | SPC00061 | SPC10388 |
| Roseburia_intestinalis | Lachnospiraceae_bacterium_5_1_57FAA | SPC00061 | SPC10390 |
| Roseburia_intestinalis | Blautia_schinkii | SPC00061 | SPC10403 |
| Roseburia_intestinalis | Alistipes_shahii | SPC00061 | SPC10414 |
| Roseburia_intestinalis | Blautia_producta | SPC00061 | SPC10415 |
| Coprococcus_catus | Coprococcus_catus | SPC00080 | SPC00061 |
| Coprococcus_catus | Erysipelotrichaceae_bacterium_3_1_53 | SPC00080 | SPC10001 |
| Coprococcus_catus | Bacteroides_sp_D20 | SPC00080 | SPC10019 |
| Coprococcus_catus | Bacteroides_ovatus | SPC00080 | SPC10030 |
| Coprococcus_catus | Parabacteroides_merdae | SPC00080 | SPC10048 |

TABLE 4a-continued

| | | |
|---|---|---|
| Coprococcus_catus | Bacteroides_vulgatus | SPC00080 SPC10081 |
| Coprococcus_catus | Collisella_aerofaciens | SPC00080 SPC10097 |
| Coprococcus_catus | Escherichia_coli | SPC00080 SPC10110 |
| Coprococcus_catus | Ruminococcus_obeum | SPC00080 SPC10197 |
| Coprococcus_catus | Bacteroides_caccae | SPC00080 SPC10211 |
| Coprococcus_catus | Bacteroides_eggerthii | SPC00080 SPC10213 |
| Coprococcus_catus | Ruminococcus_torques | SPC00080 SPC10233 |
| Coprococcus_catus | Clostridium_hathewayi | SPC00080 SPC10243 |
| Coprococcus_catus | Bifidobacterium_pseudocatenulatum | SPC00080 SPC10298 |
| Coprococcus_catus | Bifidobacterium_adolescentis | SPC00080 SPC10301 |
| Coprococcus_catus | Coprococcus_comes | SPC00080 SPC10304 |
| Coprococcus_catus | Clostridium_symbiosum | SPC00080 SPC10355 |
| Coprococcus_catus | Eubacterium_rectale | SPC00080 SPC10363 |
| Coprococcus_catus | Faecalibacterium_prausnitzii | SPC00080 SPC10386 |
| Coprococcus_catus | Odoribacter_splanchnicus | SPC00080 SPC10388 |
| Coprococcus_catus | Lachnospiraceae_bacterium_5_1_57FAA | SPC00080 SPC10390 |
| Coprococcus_catus | Blautia_schinkii | SPC00080 SPC10403 |
| Coprococcus_catus | Alistipes_shahii | SPC00080 SPC10414 |
| Coprococcus_catus | Blautia_producta | SPC00080 SPC10415 |
| Erysipelotrichaceae_bacterium_3_1_53 | Erysipelotrichaceae_bacterium_3_1_53 | SPC10001 SPC10001 |
| Erysipelotrichaceae_bacterium_3_1_53 | Bacteroides_sp_D20 | SPC10001 SPC10019 |
| Erysipelotrichaceae_bacterium_3_1_53 | Bacteroides_ovatus | SPC10001 SPC10030 |
| Erysipelotrichaceae_bacterium_3_1_53 | Parabacteroides_merdae | SPC10001 SPC10048 |
| Erysipelotrichaceae_bacterium_3_1_53 | Bacteroides_vulgatus | SPC10001 SPC10081 |
| Erysipelotrichaceae_bacterium_3_1_53 | Collinsella_aerofaciens | SPC10001 SPC10097 |
| Erysipelotrichaceae_bacterium_3_1_53 | Escherichia_coli | SPC10001 SPC10110 |
| Erysipelotrichaceae_bacterium_3_1_53 | Ruminococcus_obeum | SPC10001 SPC10197 |
| Erysipelotrichaceae_bacterium_3_1_53 | Bacteroides_caccae | SPC10001 SPC10211 |
| Erysipelotrichaceae_bacterium_3_1_53 | Bacteroides_eggerthii | SPC10001 SPC10213 |
| Erysipelotrichaceae_bacterium_3_1_53 | Ruminococcus_torques | SPC10001 SPC10233 |
| Erysipelotrichaceae_bacterium_3_1_53 | Clostridium_hathewayi | SPC10001 SPC10243 |
| Erysipelotrichaceae_bacterium_3_1_53 | Bifidobacterium_pseudocatenulatum | SPC10001 SPC10298 |
| Erysipelotrichaceae_bacterium_3_1_53 | Bifidobacterium_adolescentis | SPC10001 SPC10301 |
| Erysipelotrichaceae_bacterium_3_1_53 | Coprococcus_comes | SPC10001 SPC10304 |
| Erysipelotrichaceae_bacterium_3_1_53 | Clostridium_symbiosum | SPC10001 SPC10355 |
| Erysipelotrichaceae_bacterium_3_1_53 | Eubacterium_rectale | SPC10001 SPC10363 |
| Erysipelotrichaceae_bacterium_3_1_53 | Faecalibacterium_prausnitzii | SPC10001 SPC10386 |
| Erysipelotrichaceae_bacterium_3_1_53 | Odoribacter_splanchnicus | SPC10001 SPC10388 |
| Erysipelotrichaceae_bacterium_3_1_53 | Lachnospiraceae_bacterium_5_1_57FAA | SPC10001 SPC10390 |
| Erysipelotrichaceae_bacterium_3_1_53 | Blautia_schinkii | SPC10001 SPC10403 |
| Erysipelotrichaceae_bacterium_3_1_53 | Alistipes_shahii | SPC10001 SPC10414 |
| Erysipelotrichaceae_bacterium_3_1_53 | Blautia_producta | SPC10001 SPC10415 |
| Bacteroides_sp_D20 | Bacteroides_sp_D20 | SPC10019 SPC10019 |
| Bacteroides_sp_D20 | Bacteroides_ovatus | SPC10019 SPC10030 |
| Bacteroides_sp_D20 | Parabacteroides_merdae | SPC10019 SPC10048 |
| Bacteroides_sp_D20 | Bacteroides_vulgatus | SPC10019 SPC10081 |
| Bacteroides_sp_D20 | Collinsella_aerofaciens | SPC10019 SPC10097 |
| Bacteroides_sp_D20 | Escherichia_coli | SPC10019 SPC10110 |
| Bacteroides_sp_D20 | Ruminococcus_obeum | SPC10019 SPC10197 |
| Bacteroides_sp_D20 | Bacteroides_caccae | SPC10019 SPC10211 |
| Bacteroides_sp_D20 | Bacteroides_eggerthii | SPC10019 SPC10213 |
| Bacteroides_sp_D20 | Ruminococcus_torques | SPC10019 SPC10233 |
| Bacteroides_sp_D20 | Clostridium_hathewayi | SPC10019 SPC10243 |

TABLE 4a-continued

| | | | |
|---|---|---|---|
| Bacteroides_sp_D20 | Bifidobacterium_pseudocatenulatum | SPC10019 | SPC10298 |
| Bacteroides_sp_D20 | Bifidobacterium_adolescentis | SPC10019 | SPC10301 |
| Bacteroides_sp_D20 | Coprococcus_comes | SPC10019 | SPC10304 |
| Bacteroides_sp_D20 | Clostridium_symbiosum | SPC10019 | SPC10355 |
| Bacteroides_sp_D20 | Eubacterium_rectale | SPC10019 | SPC10363 |
| Bacteroides_sp_D20 | Faecalibacterium_prausnitzii | SPC10019 | SPC10386 |
| Bacteroides_sp_D20 | Odoribacter_splanchnicus | SPC10019 | SPC10388 |
| Bacteroides_sp_D20 | Lachnospiraceae_bacterium_5_1_57FAA | SPC10019 | SPC10390 |
| Bacteroides_sp_D20 | Blautia_schinkii | SPC10019 | SPC10403 |
| Bacteroides_sp_D20 | Alistipes_shahii | SPC10019 | SPC10414 |
| Bacteroides_sp_D20 | Blautia_producta | SPC10019 | SPC10415 |
| Bacteroides_ovatus | Bacteroides_ovatus | SPC10030 | SPC10030 |
| Bacteroides_ovatus | Parabacteroides_merdae | SPC10030 | SPC10048 |
| Bacteroides_ovatus | Bacteroides_vulgatus | SPC10030 | SPC10081 |
| Bacteroides_ovatus | Collinsella_aerofaciens | SPC10030 | SPC10097 |
| Bacteroides_ovatus | Escherichia_coli | SPC10030 | SPC10110 |
| Bacteroides_ovatus | Ruminococcus_obeum | SPC10030 | SPC10197 |
| Bacteroides_ovatus | Bacteroides_caccae | SPC10030 | SPC10211 |
| Bacteroides_ovatus | Bacteroides_eggerthii | SPC10030 | SPC10213 |
| Bacteroides_ovatus | Ruminococcus_torques | SPC10030 | SPC10233 |
| Bacteroides_ovatus | Clostridium_hathewayi | SPC10030 | SPC10243 |
| Bacteroides_ovatus | Bifidobacterium_pseudocatenulatum | SPC10030 | SPC10298 |
| Bacteroides_ovatus | Bifidobacterium_adolescentis | SPC10030 | SPC10301 |
| Bacteroides_ovatus | Coprococcus_comes | SPC10030 | SPC10304 |
| Bacteroides_ovatus | Clostridium_symbiosum | SPC10030 | SPC10355 |
| Bacteroides_ovatus | Eubacterium_rectale | SPC10030 | SPC10363 |
| Bacteroides_ovatus | Faecalibacterium_prausnitzii | SPC10030 | SPC10386 |
| Bacteroides_ovatus | Odoribacter_splanchnicus | SPC10030 | SPC10388 |
| Bacteroides_ovatus | Lachnospiraceae_bacterium_5_1_57FAA | SPC10030 | SPC10390 |
| Bacteroides_ovatus | Blautia_schinkii | SPC10030 | SPC10403 |
| Bacteroides_ovatus | Alistipes_shahii | SPC10030 | SPC10414 |
| Bacteroides_ovatus | Blautia_producta | SPC10030 | SPC10415 |
| Parabacteroides_merdae | Parabacteroides_merdae | SPC10048 | SPC10048 |
| Parabacteroides_merdae | Bacteroides_vulgatus | SPC10048 | SPC10081 |
| Parabacteroides_merdae | Collinsella_aerofaciens | SPC10048 | SPC10097 |
| Parabacteroides_merdae | Escherichia_coli | SPC10048 | SPC10110 |
| Parabacteroides_merdae | Ruminococcus_obeum | SPC10048 | SPC10197 |
| Parabacteroides_merdae | Bacteroides_caccae | SPC10048 | SPC10211 |
| Parabacteroides_merdae | Bacteroides_eggerthii | SPC10048 | SPC10213 |
| Parabacteroides_merdae | Ruminococcus_torques | SPC10048 | SPC10233 |
| Parabacteroides_merdae | Clostridium_hathewayi | SPC10048 | SPC10243 |
| Parabacteroides_merdae | Bifidobacterium_pseudocatenulatum | SPC10048 | SPC10298 |
| Parabacteroides_merdae | Bifidobacterium_adolescentis | SPC10048 | SPC10301 |
| Parabacteroides_merdae | Coprococcus_comes | SPC10048 | SPC10304 |
| Parabacteroides_merdae | Clostridium_symbiosum | SPC10048 | SPC10355 |
| Parabacteroides_merdae | Eubacterium_rectale | SPC10048 | SPC10363 |
| Parabacteroides_merdae | Faecalibacterium_prausnitzii | SPC10048 | SPC10386 |
| Parabacteroides_merdae | Odoribacter_splanchnicus | SPC10048 | SPC10388 |
| Parabacteroides_merdae | Lachnospiraceae_bacterium_5_1_57FAA | SPC10048 | SPC10390 |
| Parabacteroides_merdae | Blautia_schinkii | SPC10048 | SPC10403 |
| Parabacteroides_merdae | Alistipes_shahii | SPC10048 | SPC10414 |
| Parabacteroides_merdae | Blautia_producta | SPC10048 | SPC10415 |
| Bacteroides_vulgatus | Bacteroides_vulgatus | SPC10081 | SPC10081 |

TABLE 4a-continued

| | | | |
|---|---|---|---|
| Bacteroides_vulgatus | Collinsella_aerofaciens | SPC10081 | SPC10097 |
| Bacteroides_vulgatus | Escherichia_coli | SPC10081 | SPC10110 |
| Bacteroides_vulgatus | Ruminococcus_obeum | SPC10081 | SPC10197 |
| Bacteroides_vulgatus | Bacteroides_caccae | SPC10081 | SPC10211 |
| Bacteroides_vulgatus | Bacteroides_eggerthii | SPC10081 | SPC10213 |
| Bacteroides_vulgatus | Ruminococcus_torques | SPC10081 | SPC10233 |
| Bacteroides_vulgatus | Clostridium_hathewayi | SPC10081 | SPC10243 |
| Bacteroides_vulgatus | Bifidobacterium_pseudocatenulatum | SPC10081 | SPC10298 |
| Bacteroides_vulgatus | Bifidobacterium_adolescentis | SPC10081 | SPC10301 |
| Bacteroides_vulgatus | Coprococcus_comes | SPC10081 | SPC10304 |
| Bacteroides_vulgatus | Clostridium_symbiosum | SPC10081 | SPC10355 |
| Bacteroides_vulgatus | Eubacterium_rectale | SPC10081 | SPC10363 |
| Bacteroides_vulgatus | Faecalibacterium_prausnitzii | SPC10081 | SPC10386 |
| Bacteroides_vulgatus | Odoribacter_splanchnicus | SPC10081 | SPC10388 |
| Bacteroides_vulgatus | Lachnospiraceae_bacterium_5_1_57FAA | SPC10081 | SPC10390 |
| Bacteroides_vulgatus | Blautia_schinkii | SPC10081 | SPC10403 |
| Bacteroides_vulgatus | Alistipes_shahii | SPC10081 | SPC10414 |
| Bacteroides_vulgatus | Blautia_producta | SPC10081 | SPC10415 |
| Collinsella_aerofaciens | Collinsella_aerofaciens | SPC10097 | SPC10097 |
| Collinsella_aerofaciens | Escherichia_coli | SPC10097 | SPC10110 |
| Collinsella_aerofaciens | Ruminococcus_obeum | SPC10097 | SPC10197 |
| Collinsella_aerofaciens | Bacteroides_caccae | SPC10097 | SPC10211 |
| Collinsella_aerofaciens | Bacteroides_eggerthii | SPC10097 | SPC10213 |
| Collinsella_aerofaciens | Ruminococcus_torques | SPC10097 | SPC10233 |
| Collinsella_aerofaciens | Clostridium_hathewayi | SPC10097 | SPC10243 |
| Collinsella_aerofaciens | Bifidobacterium_pseudocatenulatum | SPC10097 | SPC10298 |
| Collinsella_aerofaciens | Bifidobacterium_adolescentis | SPC10097 | SPC10301 |
| Collinsella_aerofaciens | Coprococcus_comes | SPC10097 | SPC10304 |
| Collinsella_aerofaciens | Clostridium_symbiosum | SPC10097 | SPC10355 |
| Collinsella_aerofaciens | Eubacterium_rectale | SPC10097 | SPC10363 |
| Collinsella_aerofaciens | Faecalibacterium_prausnitzii | SPC10097 | SPC10386 |
| Collinsella_aerofaciens | Odoribacter_splanchnicus | SPC10097 | SPC10388 |
| Collinsella_aerofaciens | Lachnospiraceae_bacterium_5_1_57FAA | SPC10097 | SPC10390 |
| Collinsella_aerofaciens | Blautia_schinkii | SPC10097 | SPC10403 |
| Collinsella_aerofaciens | Alistipes_shahii | SPC10097 | SPC10414 |
| Collinsella_aerofaciens | Blautia_producta | SPC10097 | SPC10415 |
| Escherichia_coli | Escherichia_coli | SPC10110 | SPC10110 |
| Escherichia_coli | Ruminococcus_obeum | SPC10110 | SPC10197 |
| Escherichia_coli | Bacteroides_caccae | SPC10110 | SPC10211 |
| Escherichia_coli | Bacteroides_eggerthii | SPC10110 | SPC10213 |
| Escherichia_coli | Ruminococcus_torques | SPC10110 | SPC10233 |
| Escherichia_coli | Clostridium_hathewayi | SPC10110 | SPC10243 |
| Escherichia_coli | Bifidobacterium_pseudocatenulatum | SPC10110 | SPC10298 |
| Escherichia_coli | Bifidobacterium_adolescentis | SPC10110 | SPC10301 |
| Escherichia_coli | Coprococcus_comes | SPC10110 | SPC10304 |
| Escherichia_coli | Clostridium_symbiosum | SPC10110 | SPC10355 |
| Escherichia_coli | Eubacterium_rectale | SPC10110 | SPC10363 |
| Escherichia_coli | Faecalibacterium_prausnitzii | SPC10110 | SPC10386 |
| Escherichia_coli | Odoribacter_splanchnicus | SPC10110 | SPC10388 |
| Escherichia_coli | Lachnospiraceae_bacterium_5_1_57FAA | SPC10110 | SPC10390 |
| Escherichia_coli | Blautia_schinkii | SPC10110 | SPC10403 |
| Escherichia_coli | Alistipes_shahii | SPC10110 | SPC10414 |
| Escherichia_coli | Blautia_producta | SPC10110 | SPC10415 |

TABLE 4a-continued

| | | |
|---|---|---|
| Ruminococcus_obeum | Ruminococcus_obeum | SPC10197 |
| Ruminococcus_obeum | Bacteroides_caccae | SPC10197 |
| Ruminococcus_obeum | Bacteroides_eggerthii | SPC10197 |
| Ruminococcus_obeum | Ruminococcus_torques | SPC10197 |
| Ruminococcus_obeum | Clostridium_hathewayi | SPC10197 |
| Ruminococcus_obeum | Bifidobacterium_pseudocatenulatum | SPC10197 |
| Ruminococcus_obeum | Bifidobacterium_adolescentis | SPC10197 |
| Ruminococcus_obeum | Coprococcus_comes | SPC10197 |
| Ruminococcus_obeum | Clostridium_symbiosum | SPC10197 |
| Ruminococcus_obeum | Eubacterium_rectale | SPC10197 |
| Ruminococcus_obeum | Faecalibacterium_prausnitzii | SPC10197 |
| Ruminococcus_obeum | Odoribacter_splanchnicus | SPC10197 |
| Ruminococcus_obeum | Lachnospiraceae_bacterium_5_1_57FAA | SPC10197 |
| Ruminococcus_obeum | Blautia_schinkii | SPC10197 |
| Ruminococcus_obeum | Alistipes_shahii | SPC10197 |
| Ruminococcus_obeum | Blautia_producta | SPC10197 |
| Bacteroides_caccae | Bacteroides_caccae | SPC10211 |
| Bacteroides_caccae | Bacteroides_eggerthii | SPC10211 |
| Bacteroides_caccae | Ruminococcus_torques | SPC10211 |
| Bacteroides_caccae | Clostridium_hathewayi | SPC10211 |
| Bacteroides_caccae | Bifidobacterium_pseudocatenulatum | SPC10211 |
| Bacteroides_caccae | Bifidobacterium_adolescentis | SPC10211 |
| Bacteroides_caccae | Coprococcus_comes | SPC10211 |
| Bacteroides_caccae | Clostridium_symbiosum | SPC10211 |
| Bacteroides_caccae | Eubacterium_rectale | SPC10211 |
| Bacteroides_caccae | Faecalibacterium_prausnitzii | SPC10211 |
| Bacteroides_caccae | Odoribacter_splanchnicus | SPC10211 |
| Bacteroides_caccae | Lachnospiraceae_bacterium_5_1_57FAA | SPC10211 |
| Bacteroides_caccae | Blautia_schinkii | SPC10211 |
| Bacteroides_caccae | Alistipes_shahii | SPC10211 |
| Bacteroides_caccae | Blautia_producta | SPC10211 |
| Bacteroides_eggerthii | Bacteroides_eggerthii | SPC10213 |
| Bacteroides_eggerthii | Ruminococcus_torques | SPC10213 |
| Bacteroides_eggerthii | Clostridium_hathewayi | SPC10213 |
| Bacteroides_eggerthii | Bifidobacterium_pseudocatenulatum | SPC10213 |
| Bacteroides_eggerthii | Bifidobacterium_adolescentis | SPC10213 |
| Bacteroides_eggerthii | Coprococcus_comes | SPC10213 |
| Bacteroides_eggerthii | Clostridium_symbiosum | SPC10213 |
| Bacteroides_eggerthii | Eubacterium_rectale | SPC10213 |
| Bacteroides_eggerthii | Faecalibacterium_prausnitzii | SPC10213 |
| Bacteroides_eggerthii | Odoribacter_splanchnicus | SPC10213 |
| Bacteroides_eggerthii | Lachnospiraceae_bacterium_5_1_57FAA | SPC10213 |
| Bacteroides_eggerthii | Blautia_schinkii | SPC10213 |
| Bacteroides_eggerthii | Alistipes_shahii | SPC10213 |
| Bacteroides_eggerthii | Blautia_producta | SPC10213 |
| Ruminococcus_torques | Ruminococcus_torques | SPC10233 |
| Ruminococcus_torques | Clostridium_hathewayi | SPC10233 |
| Ruminococcus_torques | Bifidobacterium_pseudocatenulatum | SPC10233 |
| Ruminococcus_torques | Bifidobacterium_adolescentis | SPC10233 |
| Ruminococcus_torques | Coprococcus_comes | SPC10233 |
| Ruminococcus_torques | Clostridium_symbiosum | SPC10233 |
| Ruminococcus_torques | Eubacterium_rectale | SPC10233 |
| Ruminococcus_torques | Faecalibacterium_prausnitzii | SPC10233 |

SPC10197
SPC10211
SPC10213
SPC10233
SPC10243
SPC10298
SPC10301
SPC10304
SPC10355
SPC10363
SPC10386
SPC10388
SPC10390
SPC10403
SPC10414
SPC10415
SPC10211
SPC10213
SPC10233
SPC10243
SPC10298
SPC10301
SPC10304
SPC10355
SPC10363
SPC10386
SPC10388
SPC10390
SPC10403
SPC10414
SPC10415
SPC10213
SPC10233
SPC10243
SPC10298
SPC10301
SPC10304
SPC10355
SPC10363
SPC10386
SPC10388
SPC10390
SPC10403
SPC10414
SPC10415
SPC10233
SPC10243
SPC10298
SPC10301
SPC10304
SPC10355
SPC10363
SPC10386

TABLE 4a-continued

| | | |
|---|---|---|
| Ruminococcus_torques | Odoribacter_splanchnicus | SPC10233 SPC10388 |
| Ruminococcus_torques | Lachnospiraceae_bacterium_5_1_57FAA | SPC10233 SPC10390 |
| Ruminococcus_torques | Blautia_schinkii | SPC10233 SPC10403 |
| Ruminococcus_torques | Alistipes_shahii | SPC10233 SPC10414 |
| Ruminococcus_torques | Blautia_producta | SPC10233 SPC10415 |
| Clostridium_hathewayi | Clostridium_hathewayi | SPC10243 SPC10243 |
| Clostridium_hathewayi | Bifidobacterium_pseudocatenulatum | SPC10243 SPC10298 |
| Clostridium_hathewayi | Bifidobacterium_adolescentis | SPC10243 SPC10301 |
| Clostridium_hathewayi | Coprococcus_comes | SPC10243 SPC10304 |
| Clostridium_hathewayi | Clostridium_symbiosum | SPC10243 SPC10355 |
| Clostridium_hathewayi | Eubacterium_rectale | SPC10243 SPC10363 |
| Clostridium_hathewayi | Faecalibacterium_prausnitzii | SPC10243 SPC10386 |
| Clostridium_hathewayi | Odoribacter_splanchnicus | SPC10243 SPC10388 |
| Clostridium_hathewayi | Lachnospiraceae_bacterium_5_1_57FAA | SPC10243 SPC10390 |
| Clostridium_hathewayi | Blautia_schinkii | SPC10243 SPC10403 |
| Clostridium_hathewayi | Alistipes_shahii | SPC10243 SPC10414 |
| Clostridium_hathewayi | Blautia_producta | SPC10243 SPC10415 |
| Bifidobacterium_pseudocatenulatum | Bifidobacterium_pseudocatenulatum | SPC10298 SPC10298 |
| Bifidobacterium_pseudocatenulatum | Bifidobacterium_adolescentis | SPC10298 SPC10301 |
| Bifidobacterium_pseudocatenulatum | Coprococcus_comes | SPC10298 SPC10304 |
| Bifidobacterium_pseudocatenulatum | Clostridium_symbiosum | SPC10298 SPC10355 |
| Bifidobacterium_pseudocatenulatum | Eubacterium_rectale | SPC10298 SPC10363 |
| Bifidobacterium_pseudocatenulatum | Faecalibacterium_prausnitzii | SPC10298 SPC10386 |
| Bifidobacterium_pseudocatenulatum | Odoribacter_splanchnicus | SPC10298 SPC10388 |
| Bifidobacterium_pseudocatenulatum | Lachnospiraceae_bacterium_5_1_57FAA | SPC10298 SPC10390 |
| Bifidobacterium_pseudocatenulatum | Blautia_schinkii | SPC10298 SPC10403 |
| Bifidobacterium_pseudocatenulatum | Alistipes_shahii | SPC10298 SPC10414 |
| Bifidobacterium_pseudocatenulatum | Blautia_producta | SPC10298 SPC10415 |
| Bifidobacterium_adolescentis | Bifidobacterium_adolescentis | SPC10301 SPC10301 |
| Bifidobacterium_adolescentis | Coprococcus_comes | SPC10301 SPC10304 |
| Bifidobacterium_adolescentis | Clostridium_symbiosum | SPC10301 SPC10355 |
| Bifidobacterium_adolescentis | Eubacterium_rectale | SPC10301 SPC10363 |
| Bifidobacterium_adolescentis | Faecalibacterium_prausnitzii | SPC10301 SPC10386 |
| Bifidobacterium_adolescentis | Odoribacter_splanchnicus | SPC10301 SPC10388 |
| Bifidobacterium_adolescentis | Lachnospiraceae_bacterium_5_1_57FAA | SPC10301 SPC10390 |
| Bifidobacterium_adolescentis | Blautia_schinkii | SPC10301 SPC10403 |
| Bifidobacterium_adolescentis | Alistipes_shahii | SPC10301 SPC10414 |
| Bifidobacterium_adolescentis | Blautia_producta | SPC10301 SPC10415 |
| Coprococcus_comes | Coprococcus_comes | SPC10304 SPC10304 |
| Coprococcus_comes | Clostridium_symbiosum | SPC10304 SPC10355 |
| Coprococcus_comes | Eubacterium_rectale | SPC10304 SPC10363 |
| Coprococcus_comes | Faecalibacterium_prausnitzii | SPC10304 SPC10386 |
| Coprococcus_comes | Odoribacter_splanchnicus | SPC10304 SPC10388 |
| Coprococcus_comes | Lachnospiraceae_bacterium_5_1_57FAA | SPC10304 SPC10390 |
| Coprococcus_comes | Blautia_schinkii | SPC10304 SPC10403 |
| Coprococcus_comes | Alistipes_shahii | SPC10304 SPC10414 |
| Coprococcus_comes | Blautia_producta | SPC10304 SPC10415 |
| Clostridium_symbiosum | Clostridium_symbiosum | SPC10355 SPC10355 |
| Clostridium_symbiosum | Eubacterium_rectale | SPC10355 SPC10363 |
| Clostridium_symbiosum | Faecalibacterium_prausnitzii | SPC10355 SPC10386 |
| Clostridium_symbiosum | Odoribacter_splanchnicus | SPC10355 SPC10388 |
| Clostridium_symbiosum | Lachnospiraceae_bacterium_5_1_57FAA | SPC10355 SPC10390 |
| Clostridium_symbiosum | Blautia_schinkii | SPC10355 SPC10403 |

TABLE 4a-continued

| | | |
|---|---|---|
| Clostridium_symbiosum | Alistipes_shahii | SPC10355 SPC10414 |
| Clostridium_symbiosum | Blautia_producta | SPC10355 SPC10415 |
| Eubacterium_rectale | Eubacterium_rectale | SPC10363 SPC10363 |
| Eubacterium_rectale | Faecalibacterium_prausnitzii | SPC10363 SPC10386 |
| Eubacterium_rectale | Odoribacter_splanchnicus | SPC10363 SPC10388 |
| Eubacterium_rectale | Lachnospiraceae_bacterium_5_1_57FAA | SPC10363 SPC10390 |
| Eubacterium_rectale | Blautia_schinkii | SPC10363 SPC10403 |
| Eubacterium_rectale | Alistipes_shahii | SPC10363 SPC10414 |
| Eubacterium_rectale | Blautia_producta | SPC10363 SPC10415 |
| Faecalibacterium_prausnitzii | Faecalibacterium_prausnitzii | SPC10386 SPC10386 |
| Faecalibacterium_prausnitzii | Odoribacter_splanchnicus | SPC10386 SPC10388 |
| Faecalibacterium_prausnitzii | Lachnospiraceae_bacterium_5_1_57FAA | SPC10386 SPC10390 |
| Faecalibacterium_prausnitzii | Blautia_schinkii | SPC10386 SPC10403 |
| Faecalibacterium_prausnitzii | Alistipes_shahii | SPC10386 SPC10414 |
| Faecalibacterium_prausnitzii | Blautia_producta | SPC10386 SPC10415 |
| Odoribacter_splanchnicus | Odoribacter_splanchnicus | SPC10388 SPC10388 |
| Odoribacter_splanchnicus | Lachnospiraceae_bacterium_5_1_57FAA | SPC10388 SPC10390 |
| Odoribacter_splanchnicus | Blautia_schinkii | SPC10388 SPC10403 |
| Odoribacter_splanchnicus | Alistipes_shahii | SPC10388 SPC10414 |
| Odoribacter_splanchnicus | Blautia_producta | SPC10388 SPC10415 |
| Lachnospiraceae_bacterium_5_1_57FAA | Lachnospiraceae_bacterium_5_1_57FAA | SPC10390 SPC10390 |
| Lachnospiraceae_bacterium_5_1_57FAA | Blautia_schinkii | SPC10390 SPC10403 |
| Lachnospiraceae_bacterium_5_1_57FAA | Alistipes_shahii | SPC10390 SPC10414 |
| Lachnospiraceae_bacterium_5_1_57FAA | Blautia_producta | SPC10390 SPC10415 |
| Blautia_schinkii | Blautia_schinkii | SPC10403 SPC10403 |
| Blautia_schinkii | Alistipes_shahii | SPC10403 SPC10414 |
| Blautia_schinkii | Blautia_producta | SPC10403 SPC10415 |
| Alistipes_shahii | Alistipes_shahii | SPC10414 SPC10414 |
| Alistipes_shahii | Blautia_producta | SPC10414 SPC10415 |
| Blautia_producta | Blautia_producta | SPC10415 SPC10415 |
| Collinsella_aerofaciens | Clostridium_tertium | SPC10097 SPC10155 |
| Collinsella_aerofaciens | Clostridium_disporicum | SPC10097 SPC10167 |
| Collinsella_aerofaciens | Clostridium_innocuum | SPC10097 SPC10202 |
| Collinsella_aerofaciens | Clostridium_mayombei | SPC10097 SPC10238 |
| Collinsella_aerofaciens | Clostridium_butyricum | SPC10097 SPC10256 |
| Collinsella_aerofaciens | Clostridium_hylemonae | SPC10097 SPC10313 |
| Collinsella_aerofaciens | Clostridium_bolteae | SPC10097 SPC10325 |
| Collinsella_aerofaciens | Clostridium_orbiscindens | SPC10097 SPC10358 |
| Collinsella_aerofaciens | Ruminococcus_gnavus | SPC10097 SPC10468 |
| Collinsella_aerofaciens | Ruminococcus_bromii | SPC10097 SPC10470 |
| Collinsella_aerofaciens | Eubacterium_rectale | SPC10097 SPC10567 |
| Clostridium_tertium | Collinsella_aerofaciens | SPC10155 SPC10097 |
| Clostridium_tertium | Clostridium_tertium | SPC10155 SPC10155 |
| Clostridium_tertium | Clostridium_disporicum | SPC10155 SPC10167 |
| Clostridium_tertium | Clostridium_innocuum | SPC10155 SPC10202 |
| Clostridium_tertium | Clostridium_mayombei | SPC10155 SPC10238 |
| Clostridium_tertium | Clostridium_butyricum | SPC10155 SPC10256 |
| Clostridium_tertium | Coprococcus_comes | SPC10155 SPC10304 |
| Clostridium_tertium | Clostridium_hylemonae | SPC10155 SPC10313 |
| Clostridium_tertium | Clostridium_bolteae | SPC10155 SPC10325 |
| Clostridium_tertium | Clostridium_symbiosum | SPC10155 SPC10355 |
| Clostridium_tertium | Clostridium_orbiscindens | SPC10155 SPC10358 |
| Clostridium_tertium | Faecalibacterium_prausnitzii | SPC10155 SPC10386 |

TABLE 4a-continued

| | | |
|---|---|---|
| Clostridium_tertium | Lachnospiraceae_bacterium_5_1_57FAA | SPC10155 | SPC10390 |
| Clostridium_tertium | Blautia_producta | SPC10155 | SPC10415 |
| Clostridium_tertium | Ruminococcus_gnavus | SPC10155 | SPC10468 |
| Clostridium_tertium | Ruminococcus_bromii | SPC10155 | SPC10470 |
| Clostridium_tertium | Eubacterium_rectale | SPC10155 | SPC10567 |
| Clostridium_disporicum | Clostridium_tertium | SPC10167 | SPC10155 |
| Clostridium_disporicum | Clostridium_disporicum | SPC10167 | SPC10167 |
| Clostridium_disporicum | Clostridium_innocuum | SPC10167 | SPC10202 |
| Clostridium_disporicum | Clostridium_mayombei | SPC10167 | SPC10238 |
| Clostridium_disporicum | Clostridium_butyricum | SPC10167 | SPC10256 |
| Clostridium_disporicum | Coprococcus_comes | SPC10167 | SPC10304 |
| Clostridium_disporicum | Clostridium_hylemonae | SPC10167 | SPC10313 |
| Clostridium_disporicum | Clostridium_bolteae | SPC10167 | SPC10325 |
| Clostridium_disporicum | Clostridium_symbiosum | SPC10167 | SPC10355 |
| Clostridium_disporicum | Clostridium_orbiscindens | SPC10167 | SPC10358 |
| Clostridium_disporicum | Faecalibacterium_prausnitzii | SPC10167 | SPC10386 |
| Clostridium_disporicum | Lachnospiraceae_bacterium_5_1_57FAA | SPC10167 | SPC10390 |
| Clostridium_disporicum | Blautia_producta | SPC10167 | SPC10415 |
| Clostridium_disporicum | Ruminococcus_gnavus | SPC10167 | SPC10468 |
| Clostridium_disporicum | Ruminococcus_bromii | SPC10167 | SPC10470 |
| Clostridium_disporicum | Eubacterium_rectale | SPC10167 | SPC10567 |
| Clostridium_innocuum | Clostridium_disporicum | SPC10202 | SPC10167 |
| Clostridium_innocuum | Clostridium_innocuum | SPC10202 | SPC10202 |
| Clostridium_innocuum | Clostridium_mayombei | SPC10202 | SPC10238 |
| Clostridium_innocuum | Clostridium_butyricum | SPC10202 | SPC10256 |
| Clostridium_innocuum | Coprococcus_comes | SPC10202 | SPC10304 |
| Clostridium_innocuum | Clostridium_hylemonae | SPC10202 | SPC10313 |
| Clostridium_innocuum | Clostridium_bolteae | SPC10202 | SPC10325 |
| Clostridium_innocuum | Clostridium_symbiosum | SPC10202 | SPC10355 |
| Clostridium_innocuum | Clostridium_orbiscindens | SPC10202 | SPC10358 |
| Clostridium_innocuum | Faecalibacterium_prausnitzii | SPC10202 | SPC10386 |
| Clostridium_innocuum | Lachnospiraceae_bacterium_5_1_57FAA | SPC10202 | SPC10390 |
| Clostridium_innocuum | Blautia_producta | SPC10202 | SPC10415 |
| Clostridium_innocuum | Ruminococcus_gnavus | SPC10202 | SPC10468 |
| Clostridium_innocuum | Ruminococcus_bromii | SPC10202 | SPC10470 |
| Clostridium_innocuum | Eubacterium_rectale | SPC10202 | SPC10567 |
| Clostridium_mayombei | Clostridium_innocuum | SPC10238 | SPC10202 |
| Clostridium_mayombei | Clostridium_mayombei | SPC10238 | SPC10238 |
| Clostridium_mayombei | Clostridium_butyricum | SPC10238 | SPC10256 |
| Clostridium_mayombei | Coprococcus_comes | SPC10238 | SPC10304 |
| Clostridium_mayombei | Clostridium_hylemonae | SPC10238 | SPC10313 |
| Clostridium_mayombei | Clostridium_bolteae | SPC10238 | SPC10325 |
| Clostridium_mayombei | Clostridium_symbiosum | SPC10238 | SPC10355 |
| Clostridium_mayombei | Clostridium_orbiscindens | SPC10238 | SPC10358 |
| Clostridium_mayombei | Faecalibacterium_prausnitzii | SPC10238 | SPC10386 |
| Clostridium_mayombei | Lachnospiraceae_bacterium_5_1_57FAA | SPC10238 | SPC10390 |
| Clostridium_mayombei | Blautia_producta | SPC10238 | SPC10415 |
| Clostridium_mayombei | Ruminococcus_gnavus | SPC10238 | SPC10468 |
| Clostridium_mayombei | Ruminococcus_bromii | SPC10238 | SPC10470 |
| Clostridium_mayombei | Eubacterium_rectale | SPC10238 | SPC10567 |
| Clostridium_butyricum | Clostridium_mayombei | SPC10256 | SPC10238 |
| Clostridium_butyricum | Clostridium_butyricum | SPC10256 | SPC10256 |
| Clostridium_butyricum | Coprococcus_comes | SPC10256 | SPC10304 |

TABLE 4a-continued

| | | |
|---|---|---|
| Clostridium_butyricum | Clostridium_hylemonae | SPC10256 SPC10313 |
| Clostridium_butyricum |

TABLE 4a-continued

| | | | |
|---|---|---|---|
| Faecalibacterium_prausnitzii | Ruminococcus_bromii | SPC10386 | SPC10470 |
| Faecalibacterium_prausnitzii | Eubacterium_rectale | SPC10386 | SPC10567 |
| Lachnospiraceae_bacterium_5_1_57FAA | Ruminococcus_gnavus | SPC10390 | SPC10468 |
| Lachnospiraceae_bacterium_5_1_57FAA | Ruminococcus_bromii | SPC10390 | SPC10470 |
| Lachnospiraceae_bacterium_5_1_57FAA | Eubacterium_rectale | SPC10390 | SPC10567 |
| Blautia_producta | Ruminococcus_gnavus | SPC10415 | SPC10468 |
| Blautia_producta | Ruminococcus_bromii | SPC10415 | SPC10470 |
| Blautia_producta | Eubacterium_rectale | SPC10415 | SPC10567 |
| Ruminococcus_gnavus | Blautia_producta | SPC10468 | SPC10415 |
| Ruminococcus_gnavus | Ruminococcus_gnavus | SPC10468 | SPC10468 |
| Ruminococcus_gnavus | Ruminococcus_bromii | SPC10468 | SPC10470 |
| Ruminococcus_gnavus | Eubacterium_rectale | SPC10468 | SPC10567 |
| Ruminococcus_bromii | Ruminococcus_gnavus | SPC10470 | SPC10468 |
| Ruminococcus_bromii | Ruminococcus_bromii | SPC10470 | SPC10470 |
| Ruminococcus_bromii | Eubacterium_rectale | SPC10470 | SPC10567 |
| Eubacterium_rectale | Ruminococcus_bromii | SPC10567 | SPC10470 |
| Eubacterium_rectale | Eubacterium_rectale | SPC10567 | SPC10567 |
| Collinsella_aerofaciens | Collinsella_aerofaciens | SPC10097 | SPC10097 |
| Collinsella_aerofaciens | Coprococcus_comes | SPC10097 | SPC10304 |
| Collinsella_aerofaciens | Clostridium_bolteae | SPC10097 | SPC10325 |
| Collinsella_aerofaciens | Clostridium_symbiosum | SPC10097 | SPC10355 |
| Collinsella_aerofaciens | Faecalibacterium_prausnitzii | SPC10097 | SPC10386 |
| Collinsella_aerofaciens | Lachnospiraceae_bacterium_5_1_57FAA | SPC10097 | SPC10390 |
| Collinsella_aerofaciens | Blautia_producta | SPC10097 | SPC10415 |
| Collinsella_aerofaciens | Eubacterium_rectale | SPC10097 | SPC10567 |
| Coprococcus_comes | Collinsella_aerofaciens | SPC10304 | SPC10097 |
| Coprococcus_comes | Coprococcus_comes | SPC10304 | SPC10304 |
| Coprococcus_comes | Clostridium_bolteae | SPC10304 | SPC10325 |
| Coprococcus_comes | Clostridium_symbiosum | SPC10304 | SPC10355 |
| Coprococcus_comes | Faecalibacterium_prausnitzii | SPC10304 | SPC10386 |
| Coprococcus_comes | Lachnospiraceae_bacterium_5_1_57FAA | SPC10304 | SPC10390 |
| Coprococcus_comes | Blautia_producta | SPC10304 | SPC10415 |
| Coprococcus_comes | Eubacterium_rectale | SPC10304 | SPC10567 |
| Clostridium_bolteae | Collinsella_aerofaciens | SPC10325 | SPC10097 |
| Clostridium_bolteae | Coprococcus_comes | SPC10325 | SPC10304 |
| Clostridium_bolteae | Clostridium_bolteae | SPC10325 | SPC10325 |
| Clostridium_bolteae | Clostridium_symbiosum | SPC10325 | SPC10355 |
| Clostridium_bolteae | Faecalibacterium_prausnitzii | SPC10325 | SPC10386 |
| Clostridium_bolteae | Lachnospiraceae_bacterium_5_1_57FAA | SPC10325 | SPC10390 |
| Clostridium_bolteae | Blautia_producta | SPC10325 | SPC10415 |
| Clostridium_bolteae | Eubacterium_rectale | SPC10325 | SPC10567 |
| Clostridium_symbiosum | Collinsella_aerofaciens | SPC10355 | SPC10097 |
| Clostridium_symbiosum | Coprococcus_comes | SPC10355 | SPC10304 |
| Clostridium_symbiosum | Clostridium_bolteae | SPC10355 | SPC10325 |
| Clostridium_symbiosum | Clostridium_symbiosum | SPC10355 | SPC10355 |
| Clostridium_symbiosum | Faecalibacterium_prausnitzii | SPC10355 | SPC10386 |
| Clostridium_symbiosum | Lachnospiraceae_bacterium_5_1_57FAA | SPC10355 | SPC10390 |
| Clostridium_symbiosum | Blautia_producta | SPC10355 | SPC10415 |
| Clostridium_symbiosum | Eubacterium_rectale | SPC10355 | SPC10567 |
| Faecalibacterium_prausnitzii | Collinsella_aerofaciens | SPC10386 | SPC10097 |
| Faecalibacterium_prausnitzii | Faecalibacterium_prausnitzii | SPC10386 | SPC10386 |
| Faecalibacterium_prausnitzii | Lachnospiraceae_bacterium_5_1_57FAA | SPC10386 | SPC10390 |
| Faecalibacterium_prausnitzii | Blautia_producta | SPC10386 | SPC10415 |
| Faecalibacterium_prausnitzii | Eubacterium_rectale | SPC10386 | SPC10567 |
| Lachnospiraceae_bacterium_5_1_57FAA | Lachnospiraceae_bacterium_5_1_57FAA | SPC10390 | SPC10390 |
| Lachnospiraceae_bacterium_5_1_57FAA | Blautia_producta | SPC10390 | SPC10415 |
| Lachnospiraceae_bacterium_5_1_57FAA | Eubacterium_rectale | SPC10390 | SPC10567 |
| Blautia_producta | Blautia_producta | SPC10415 | SPC10415 |
| Blautia_producta | Eubacterium_rectale | SPC10415 | SPC10567 |
| Eubacterium_rectale | Eubacterium_rectale | SPC10567 | SPC10567 |

TABLE 4a-continued

| | | | |
|---|---|---|---|
| Coprococcus_comes | Coprococcus_comes | SPC10304 | SPC10304 |
| Coprococcus_comes | Coprococcus_comes | SPC10304 | SPC10325 |
| Coprococcus_comes | Clostridium_bolteae | SPC10304 | SPC10355 |
| Coprococcus_comes | Clostridium_symbiosum | SPC10304 | SPC10386 |
| Coprococcus_comes | Faecalibacterium_prausnitzii | SPC10304 | SPC10390 |
| Coprococcus_comes | Lachnospiraceae_bacterium_5_1_57FAA | SPC10304 | SPC10415 |
| Coprococcus_comes | Blautia_producta | SPC10304 | SPC10567 |
| Coprococcus_comes | Eubacterium_rectale | SPC10304 | SPC10325 |
| Coprococcus_comes | Clostridium_bolteae | SPC10304 | SPC10355 |
| Coprococcus_comes | Clostridium_symbiosum | SPC10304 | SPC10386 |
| Coprococcus_comes | Faecalibacterium_prausnitzii | SPC10304 | SPC10390 |
| Coprococcus_comes | Lachnospiraceae_bacterium_5_1_57FAA | SPC10304 | SPC10415 |
| Coprococcus_comes | Blautia_producta | SPC10304 | SPC10567 |
| Coprococcus_comes | Eubacterium_rectale | SPC10304 | SPC10355 |
| Coprococcus_comes | Clostridium_symbiosum | SPC10304 | SPC10386 |
| Coprococcus_comes | Faecalibacterium_prausnitzii | SPC10304 | SPC10390 |
| Coprococcus_comes | Lachnospiraceae_bacterium_5_1_57FAA | SPC10304 | SPC10415 |
| Coprococcus_comes | Blautia_producta | SPC10304 | SPC10567 |
| Coprococcus_comes | Eubacterium_rectale | SPC10304 | SPC10386 |
| Coprococcus_comes | Faecalibacterium_prausnitzii | SPC10304 | SPC10390 |
| Coprococcus_comes | Lachnospiraceae_bacterium_5_1_57FAA | SPC10304 | SPC10415 |
| Coprococcus_comes | Blautia_producta | SPC10304 | SPC10567 |
| Coprococcus_comes | Faecalibacterium_prausnitzii | SPC10304 | SPC10390 |
| Coprococcus_comes | Lachnospiraceae_bacterium_5_1_57FAA | SPC10304 | SPC10415 |
| Coprococcus_comes | Blautia_producta | SPC10304 | SPC10567 |
| Coprococcus_comes | Eubacterium_rectale | SPC10304 | SPC10415 |
| Coprococcus_comes | Blautia_producta | SPC10304 | SPC10567 |
| Coprococcus_comes | Eubacterium_rectale | SPC10325 | SPC10355 |
| Clostridium_bolteae | Clostridium_bolteae | SPC10325 | SPC10355 |
| Clostridium_bolteae | Clostridium_symbiosum | SPC10325 | SPC10386 |
| Clostridium_bolteae | Faecalibacterium_prausnitzii | SPC10325 | SPC10390 |
| Clostridium_bolteae | Lachnospiraceae_bacterium_5_1_57FAA | SPC10325 | SPC10415 |
| Clostridium_bolteae | Blautia_producta | SPC10325 | SPC10567 |
| Clostridium_bolteae | Eubacterium_rectale | SPC10325 | SPC10355 |
| Clostridium_bolteae | Clostridium_symbiosum | SPC10325 | SPC10386 |
| Clostridium_bolteae | Faecalibacterium_prausnitzii | SPC10325 | SPC10390 |
| Clostridium_bolteae | Lachnospiraceae_bacterium_5_1_57FAA | SPC10325 | SPC10415 |
| Clostridium_bolteae | Blautia_producta | SPC10325 | SPC10567 |
| Clostridium_bolteae | Eubacterium_rectale | SPC10325 | SPC10386 |
| Clostridium_bolteae | Faecalibacterium_prausnitzii | SPC10325 | SPC10390 |
| Clostridium_bolteae | Lachnospiraceae_bacterium_5_1_57FAA | SPC10325 | SPC10415 |
| Clostridium_bolteae | Blautia_producta | SPC10325 | SPC10567 |
| Clostridium_bolteae | Eubacterium_rectale | SPC10325 | SPC10415 |
| Clostridium_bolteae | Blautia_producta | SPC10325 | SPC10567 |
| Clostridium_bolteae | Eubacterium_rectale | SPC10355 | SPC10415 |
| Clostridium_symbiosum | Clostridium_symbiosum | SPC10355 | SPC10386 |
| Clostridium_symbiosum | Faecalibacterium_prausnitzii | SPC10355 | SPC10390 |
| Clostridium_symbiosum | Blautia_producta | SPC10355 | SPC10415 |

TABLE 4a-continued

| | | | |
|---|---|---|---|
| Clostridium_symbiosum | Clostridium_symbiosum | SPC10355 | SPC10567 |
| Clostridium_symbiosum | Faecalibacterium_prausnitzii | SPC10355 | SPC10386 |
| Clostridium_symbiosum | Lachnospiraceae_bacterium_5_1_57FAA | SPC10355 | SPC10390 |
| Clostridium_symbiosum | Blautia_producta | SPC10355 | SPC10415 |
| Clostridium_symbiosum | Eubacterium_rectale | SPC10355 | SPC10567 |
| Clostridium_symbiosum | Faecalibacterium_prausnitzii | SPC10355 | SPC10386 |
| Clostridium_symbiosum | Lachnospiraceae_bacterium_5_1_57FAA | SPC10355 | SPC10390 |
| Clostridium_symbiosum | Blautia_producta | SPC10355 | SPC10415 |
| Clostridium_symbiosum | Eubacterium_rectale | SPC10355 | SPC10567 |
| Faecalibacterium_prausnitzii | Faecalibacterium_prausnitzii | SPC10386 | SPC10386 |
| Faecalibacterium_prausnitzii | Lachnospiraceae_bacterium_5_1_57FAA | SPC10386 | SPC10390 |
| Faecalibacterium_prausnitzii | Blautia_producta | SPC10386 | SPC10415 |
| Faecalibacterium_prausnitzii | Eubacterium_rectale | SPC10386 | SPC10567 |
| Faecalibacterium_prausnitzii | Faecalibacterium_prausnitzii | SPC10386 | SPC10386 |
| Faecalibacterium_prausnitzii | Lachnospiraceae_bacterium_5_1_57FAA | SPC10386 | SPC10390 |
| Faecalibacterium_prausnitzii | Blautia_producta | SPC10386 | SPC10415 |
| Faecalibacterium_prausnitzii | Eubacterium_rectale | SPC10386 | SPC10567 |
| Lachnospiraceae_bacterium_5_1_57FAA | Lachnospiraceae_bacterium_5_1_57FAA | SPC10390 | SPC10390 |
| Lachnospiraceae_bacterium_5_1_57FAA | Blautia_producta | SPC10390 | SPC10415 |
| Lachnospiraceae_bacterium_5_1_57FAA | Eubacterium_rectale | SPC10390 | SPC10567 |
| Lachnospiraceae_bacterium_5_1_57FAA | Blautia_producta | SPC10390 | SPC10415 |
| Lachnospiraceae_bacterium_5_1_57FAA | Eubacterium_rectale | SPC10390 | SPC10567 |
| Blautia_producta | Blautia_producta | SPC10415 | SPC10415 |
| Blautia_producta | Eubacterium_rectale | SPC10415 | SPC10567 |
| Blautia_producta | Eubacterium_rectale | SPC10415 | SPC10567 |
| Eubacterium_rectale | Eubacterium_rectale | SPC10567 | SPC10567 |
| Collinsella_aerofaciens | Clostridium_tertium | SPC10097 | SPC10155 |
| Collinsella_aerofaciens | Clostridium_disporicum | SPC10097 | SPC10167 |
| Collinsella_aerofaciens | Clostridium_innocuum | SPC10097 | SPC10202 |
| Collinsella_aerofaciens | Clostridium_mayombei | SPC10097 | SPC10238 |
| Collinsella_aerofaciens | Clostridium_butyricum | SPC10097 | SPC10256 |
| Collinsella_aerofaciens | Clostridium_hylemonae | SPC10097 | SPC10313 |
| Collinsella_aerofaciens | Clostridium_orbiscindens | SPC10097 | SPC10358 |
| Collinsella_aerofaciens | Ruminococcus_gnavus | SPC10097 | SPC10468 |
| Collinsella_aerofaciens | Ruminococcus_bromii | SPC10097 | SPC10470 |
| Collinsella_aerofaciens | Blautia_sp_M25 | SPC10097 | SPC10613 |
| Collinsella_aerofaciens | Clostridium_disporicum | SPC10097 | SPC10167 |
| Collinsella_aerofaciens | Clostridium_innocuum | SPC10097 | SPC10202 |
| Collinsella_aerofaciens | Clostridium_mayombei | SPC10097 | SPC10238 |
| Collinsella_aerofaciens | Clostridium_butyricum | SPC10097 | SPC10256 |
| Collinsella_aerofaciens | Clostridium_hylemonae | SPC10097 | SPC10313 |
| Collinsella_aerofaciens | Clostridium_orbiscindens | SPC10097 | SPC10358 |
| Collinsella_aerofaciens | Ruminococcus_gnavus | SPC10097 | SPC10468 |
| Collinsella_aerofaciens | Ruminococcus_bromii | SPC10097 | SPC10470 |
| Collinsella_aerofaciens | Blautia_sp_M25 | SPC10097 | SPC10613 |
| Collinsella_aerofaciens | Clostridium_innocuum | SPC10097 | SPC10202 |
| Collinsella_aerofaciens | Clostridium_mayombei | SPC10097 | SPC10238 |
| Collinsella_aerofaciens | Clostridium_butyricum | SPC10097 | SPC10256 |

TABLE 4a-continued

| | | | |
|---|---|---|---|
| Collinsella_aerofaciens | Clostridium_innocuum | SPC10097 | SPC10202 | SPC10313 |
| Collinsella_aerofaciens | Clostridium_innocuum | SPC10097 | SPC10202 | SPC10358 |
| Collinsella_aerofaciens | Clostridium_innocuum | SPC10097 | SPC10202 | SPC10468 |
| Collinsella_aerofaciens | Clostridium_innocuum | SPC10097 | SPC10202 | SPC10470 |
| Collinsella_aerofaciens | Clostridium_innocuum | SPC10097 | SPC10202 | SPC10613 |
| Collinsella_aerofaciens | Clostridium_mayombei | SPC10097 | SPC10238 | SPC10238 |
| Collinsella_aerofaciens | Clostridium_mayombei | SPC10097 | SPC10238 | SPC10256 |
| Collinsella_aerofaciens | Clostridium_mayombei | SPC10097 | SPC10238 | SPC10313 |
| Collinsella_aerofaciens | Clostridium_mayombei | SPC10097 | SPC10238 | SPC10358 |
| Collinsella_aerofaciens | Clostridium_mayombei | SPC10097 | SPC10238 | SPC10468 |
| Collinsella_aerofaciens | Clostridium_mayombei | SPC10097 | SPC10238 | SPC10470 |
| Collinsella_aerofaciens | Clostridium_mayombei | SPC10097 | SPC10238 | SPC10613 |
| Collinsella_aerofaciens | Blautia_sp_M25 | SPC10097 | SPC10256 | SPC10256 |
| Collinsella_aerofaciens | Clostridium_butyricum | SPC10097 | SPC10256 | SPC10313 |
| Collinsella_aerofaciens | Clostridium_butyricum | SPC10097 | SPC10256 | SPC10358 |
| Collinsella_aerofaciens | Clostridium_butyricum | SPC10097 | SPC10256 | SPC10468 |
| Collinsella_aerofaciens | Clostridium_butyricum | SPC10097 | SPC10256 | SPC10470 |
| Collinsella_aerofaciens | Clostridium_butyricum | SPC10097 | SPC10256 | SPC10613 |
| Collinsella_aerofaciens | Ruminococcus_gnavus | SPC10097 | SPC10313 | SPC10313 |
| Collinsella_aerofaciens | Ruminococcus_bromii | SPC10097 | SPC10313 | SPC10358 |
| Collinsella_aerofaciens | Blautia_sp_M25 | SPC10097 | SPC10313 | SPC10468 |
| Collinsella_aerofaciens | Clostridium_hylemonae | SPC10097 | SPC10313 | SPC10470 |
| Collinsella_aerofaciens | Clostridium_hylemonae | SPC10097 | SPC10313 | SPC10613 |
| Collinsella_aerofaciens | Clostridium_hylemonae | SPC10097 | SPC10358 | SPC10358 |
| Collinsella_aerofaciens | Clostridium_orbiscindens | SPC10097 | SPC10358 | SPC10468 |
| Collinsella_aerofaciens | Ruminococcus_gnavus | SPC10097 | SPC10358 | SPC10470 |
| Collinsella_aerofaciens | Ruminococcus_bromii | SPC10097 | SPC10358 | SPC10613 |
| Collinsella_aerofaciens | Blautia_sp_M25 | SPC10097 | SPC10468 | SPC10468 |
| Collinsella_aerofaciens | Ruminococcus_gnavus | SPC10097 | SPC10468 | SPC10470 |
| Collinsella_aerofaciens | Ruminococcus_gnavus | SPC10097 | SPC10468 | SPC10613 |
| Coprococcus_comes | Clostridium_tertium | SPC10304 | SPC10155 | SPC10155 |
| Coprococcus_comes | Clostridium_disporicum | SPC10304 | SPC10155 | SPC10167 |
| Coprococcus_comes | Clostridium_innocuum | SPC10304 | SPC10155 | SPC10202 |
| Coprococcus_comes | Clostridium_mayombei | SPC10304 | SPC10155 | SPC10238 |
| Coprococcus_comes | Clostridium_butyricum | SPC10304 | SPC10155 | SPC10256 |
| Coprococcus_comes | Clostridium_hylemonae | SPC10304 | SPC10155 | SPC10313 |
| Coprococcus_comes | Clostridium_orbiscindens | SPC10304 | SPC10155 | SPC10358 |
| Coprococcus_comes | Ruminococcus_gnavus | SPC10304 | SPC10155 | SPC10468 |
| Coprococcus_comes | Ruminococcus_bromii | SPC10304 | SPC10155 | SPC10470 |
| Coprococcus_comes | Blautia_sp_M25 | SPC10304 | SPC10155 | SPC10613 |
| Coprococcus_comes | Clostridium_disporicum | SPC10304 | SPC10167 | SPC10167 |
| Coprococcus_comes | Clostridium_innocuum | SPC10304 | SPC10167 | SPC10202 |
| Coprococcus_comes | Clostridium_mayombei | SPC10304 | SPC10167 | SPC10238 |
| Coprococcus_comes | Clostridium_butyricum | SPC10304 | SPC10167 | SPC10256 |
| Coprococcus_comes | Clostridium_hylemonae | SPC10304 | SPC10167 | SPC10313 |
| Coprococcus_comes | Clostridium_orbiscindens | SPC10304 | SPC10167 | SPC10358 |
| Coprococcus_comes | Ruminococcus_gnavus | SPC10304 | SPC10167 | SPC10468 |
| Coprococcus_comes | Ruminococcus_bromii | SPC10304 | SPC10167 | SPC10470 |
| Coprococcus_comes | Blautia_sp_M25 | SPC10304 | SPC10167 | SPC10613 |
| Coprococcus_comes | Clostridium_innocuum | SPC10304 | SPC10202 | SPC10202 |
| Coprococcus_comes | Clostridium_mayombei | SPC10304 | SPC10202 | SPC10238 |
| Coprococcus_comes | Clostridium_butyricum | SPC10304 | SPC10202 | SPC10256 |
| Coprococcus_comes | Clostridium_hylemonae | SPC10304 | SPC10202 | SPC10313 |

TABLE 4a-continued

| | | | |
|---|---|---|---|
| Coprococcus_comes | Clostridium_innocuum | Clostridium_orbiscindens | SPC10304 | SPC10202 | SPC10358 |
| Coprococcus_comes | Clostridium_innocuum | Ruminococcus_gnavus | SPC10304 | SPC10202 | SPC10468 |
| Coprococcus_comes | Clostridium_innocuum | Ruminococcus_bromii | SPC10304 | SPC10202 | SPC10470 |
| Coprococcus_comes | Clostridium_innocuum | Blautia_sp_M25 | SPC10304 | SPC10202 | SPC10613 |
| Coprococcus_comes | Clostridium_mayombei | Clostridium_mayombei | SPC10304 | SPC10238 | SPC10238 |
| Coprococcus_comes | Clostridium_mayombei | Clostridium_butyricum | SPC10304 | SPC10238 | SPC10256 |
| Coprococcus_comes | Clostridium_mayombei | Clostridium_hylemonae | SPC10304 | SPC10238 | SPC10313 |
| Coprococcus_comes | Clostridium_mayombei | Clostridium_orbiscindens | SPC10304 | SPC10238 | SPC10358 |
| Coprococcus_comes | Clostridium_mayombei | Ruminococcus_gnavus | SPC10304 | SPC10238 | SPC10468 |
| Coprococcus_comes | Clostridium_mayombei | Ruminococcus_bromii | SPC10304 | SPC10238 | SPC10470 |
| Coprococcus_comes | Clostridium_mayombei | Blautia_sp_M25 | SPC10304 | SPC10238 | SPC10613 |
| Coprococcus_comes | Clostridium_butyricum | Clostridium_butyricum | SPC10304 | SPC10256 | SPC10256 |
| Coprococcus_comes | Clostridium_butyricum | Clostridium_hylemonae | SPC10304 | SPC10256 | SPC10313 |
| Coprococcus_comes | Clostridium_butyricum | Clostridium_orbiscindens | SPC10304 | SPC10256 | SPC10358 |
| Coprococcus_comes | Clostridium_butyricum | Ruminococcus_gnavus | SPC10304 | SPC10256 | SPC10468 |
| Coprococcus_comes | Clostridium_butyricum | Ruminococcus_bromii | SPC10304 | SPC10256 | SPC10470 |
| Coprococcus_comes | Clostridium_butyricum | Blautia_sp_M25 | SPC10304 | SPC10256 | SPC10613 |
| Coprococcus_comes | Clostridium_hylemonae | Clostridium_hylemonae | SPC10304 | SPC10313 | SPC10313 |
| Coprococcus_comes | Clostridium_hylemonae | Clostridium_orbiscindens | SPC10304 | SPC10313 | SPC10358 |
| Coprococcus_comes | Clostridium_hylemonae | Ruminococcus_gnavus | SPC10304 | SPC10313 | SPC10468 |
| Coprococcus_comes | Clostridium_hylemonae | Ruminococcus_bromii | SPC10304 | SPC10313 | SPC10470 |
| Coprococcus_comes | Clostridium_hylemonae | Blautia_sp_M25 | SPC10304 | SPC10313 | SPC10613 |
| Coprococcus_comes | Clostridium_orbiscindens | Clostridium_orbiscindens | SPC10304 | SPC10358 | SPC10358 |
| Coprococcus_comes | Clostridium_orbiscindens | Ruminococcus_guavas | SPC10304 | SPC10358 | SPC10468 |
| Coprococcus_comes | Clostridium_orbiscindens | Ruminococcus_bromii | SPC10304 | SPC10358 | SPC10470 |
| Coprococcus_comes | Clostridium_orbiscindens | Blautia_sp_M25 | SPC10304 | SPC10358 | SPC10613 |
| Coprococcus_comes | Ruminococcus_gnavus | Ruminococcus_gnavus | SPC10304 | SPC10468 | SPC10468 |
| Coprococcus_comes | Ruminococcus_gnavus | Ruminococcus_bromii | SPC10304 | SPC10468 | SPC10470 |
| Coprococcus_comes | Ruminococcus_gnavus | Blautia_sp_M25 | SPC10304 | SPC10468 | SPC10613 |
| Coprococcus_comes | Clostridium_tertium | Clostridium_tertium | SPC10304 | SPC10155 | SPC10155 |
| Clostridium_bolteae | Clostridium_tertium | Clostridium_disporicum | SPC10325 | SPC10155 | SPC10167 |
| Clostridium_bolteae | Clostridium_tertium | Clostridium_innocuum | SPC10325 | SPC10155 | SPC10202 |
| Clostridium_bolteae | Clostridium_tertium | Clostridium_mayombei | SPC10325 | SPC10155 | SPC10238 |
| Clostridium_bolteae | Clostridium_tertium | Clostridium_butyricum | SPC10325 | SPC10155 | SPC10256 |
| Clostridium_bolteae | Clostridium_tertium | Clostridium_hylemonae | SPC10325 | SPC10155 | SPC10313 |
| Clostridium_bolteae | Clostridium_tertium | Clostridium_orbiscindens | SPC10325 | SPC10155 | SPC10358 |
| Clostridium_bolteae | Clostridium_tertium | Ruminococcus_gnavus | SPC10325 | SPC10155 | SPC10468 |
| Clostridium_bolteae | Clostridium_tertium | Ruminococcus_bromii | SPC10325 | SPC10155 | SPC10470 |
| Clostridium_bolteae | Clostridium_tertium | Blautia_sp_M25 | SPC10325 | SPC10155 | SPC10613 |
| Clostridium_bolteae | Clostridium_disporicum | Clostridium_disporicum | SPC10325 | SPC10167 | SPC10167 |
| Clostridium_bolteae | Clostridium_disporicum | Clostridium_innocuum | SPC10325 | SPC10167 | SPC10202 |
| Clostridium_bolteae | Clostridium_disporicum | Clostridium_mayombei | SPC10325 | SPC10167 | SPC10238 |
| Clostridium_bolteae | Clostridium_disporicum | Clostridium_butyricum | SPC10325 | SPC10167 | SPC10256 |
| Clostridium_bolteae | Clostridium_disporicum | Clostridium_hylemonae | SPC10325 | SPC10167 | SPC10313 |
| Clostridium_bolteae | Clostridium_disporicum | Clostridium_orbiscindens | SPC10325 | SPC10167 | SPC10358 |
| Clostridium_bolteae | Clostridium_disporicum | Ruminococcus_gnavus | SPC10325 | SPC10167 | SPC10468 |
| Clostridium_bolteae | Clostridium_disporicum | Ruminococcus_bromii | SPC10325 | SPC10167 | SPC10470 |
| Clostridium_bolteae | Clostridium_disporicum | Blautia_sp_M25 | SPC10325 | SPC10167 | SPC10613 |
| Clostridium_bolteae | Clostridium_innocuum | Clostridium_innocuum | SPC10325 | SPC10202 | SPC10202 |
| Clostridium_bolteae | Clostridium_innocuum | Clostridium_mayombei | SPC10325 | SPC10202 | SPC10238 |
| Clostridium_bolteae | Clostridium_innocuum | Clostridium_butyricum | SPC10325 | SPC10202 | SPC10256 |
| Clostridium_bolteae | Clostridium_innocuum | Clostridium_hylemonae | SPC10325 | SPC10202 | SPC10313 |
| Clostridium_bolteae | Clostridium_innocuum | Clostridium_orbiscindens | SPC10325 | SPC10202 | SPC10358 |

TABLE 4a-continued

| | | | |
|---|---|---|---|
| Clostridium_bolteae | Clostridium_innocuum | Ruminococcus_gnavus | SPC10325 | SPC10202 | SPC10468 |
| Clostridium_bolteae | Clostridium_innocuum | Ruminococcus_bromii | SPC10325 | SPC10202 | SPC10470 |
| Clostridium_bolteae | Clostridium_innocuum | Blautia_sp_M25 | SPC10325 | SPC10202 | SPC10613 |
| Clostridium_bolteae | Clostridium_mayombei | Clostridium_butyricum | SPC10325 | SPC10238 | SPC10256 |
| Clostridium_bolteae | Clostridium_mayombei | Clostridium_hylemonae | SPC10325 | SPC10238 | SPC10313 |
| Clostridium_bolteae | Clostridium_mayombei | Clostridium_orbiscindens | SPC10325 | SPC10238 | SPC10358 |
| Clostridium_bolteae | Clostridium_mayombei | Ruminococcus_gnavus | SPC10325 | SPC10238 | SPC10468 |
| Clostridium_bolteae | Clostridium_mayombei | Ruminococcus_bromii | SPC10325 | SPC10238 | SPC10470 |
| Clostridium_bolteae | Clostridium_mayombei | Blautia_sp_M25 | SPC10325 | SPC10238 | SPC10613 |
| Clostridium_bolteae | Clostridium_butyricum | Clostridium_hylemonae | SPC10325 | SPC10256 | SPC10313 |
| Clostridium_bolteae | Clostridium_butyricum | Clostridium_orbiscindens | SPC10325 | SPC10256 | SPC10358 |
| Clostridium_bolteae | Clostridum_butyricum | Ruminococcus_gnavus | SPC10325 | SPC10256 | SPC10468 |
| Clostridium_bolteae | Clostridium_butyricum | Ruminococcus_bromii | SPC10325 | SPC10256 | SPC10470 |
| Clostridium_bolteae | Clostridium_butyricum | Blautia_sp_M25 | SPC10325 | SPC10256 | SPC10613 |
| Clostridium_bolteae | Clostridium_hylemonae | Clostridium_orbiscindens | SPC10325 | SPC10313 | SPC10358 |
| Clostridium_bolteae | Clostridium_hylemonae | Ruminococcus_gnavus | SPC10325 | SPC10313 | SPC10468 |
| Clostridium_bolteae | Clostridium_hylemonae | Ruminococcus_bromii | SPC10325 | SPC10313 | SPC10470 |
| Clostridium_bolteae | Clostridium_hylemonae | Blautia_sp_M25 | SPC10325 | SPC10313 | SPC10613 |
| Clostridium_bolteae | Clostridium_orbiscindens | Ruminococcus_gnavus | SPC10325 | SPC10358 | SPC10468 |
| Clostridium_bolteae | Clostridium_orbiscindens | Ruminococcus_bromii | SPC10325 | SPC10358 | SPC10470 |
| Clostridium_bolteae | Clostridium_orbiscindens | Blautia_sp_M25 | SPC10325 | SPC10358 | SPC10613 |
| Clostridium_bolteae | Ruminococcus_gnavus | Ruminococcus_bromii | SPC10325 | SPC10468 | SPC10470 |
| Clostridium_bolteae | Ruminococcus_gnavus | Blautia_sp_M25 | SPC10325 | SPC10468 | SPC10613 |
| Clostridium_bolteae | Ruminococcus_bromii | Blautia_sp_M25 | SPC10325 | SPC10470 | SPC10613 |
| Clostridium_symbiosum | Clostridium_tertium | Clostridium_disporicum | SPC10355 | SPC10155 | SPC10468 |
| Clostridium_symbiosum | Clostridium_tertium | Clostridium_innocuum | SPC10355 | SPC10155 | SPC10167 |
| Clostridium_symbiosum | Clostridium_tertium | Clostridium_mayombei | SPC10355 | SPC10155 | SPC10202 |
| Clostridium_symbiosum | Clostridium_tertium | Clostridium_butyricum | SPC10355 | SPC10155 | SPC10238 |
| Clostridium_symbiosum | Clostridium_tertium | Clostridium_hylemonae | SPC10355 | SPC10155 | SPC10256 |
| Clostridium_symbiosum | Clostridium_tertium | Clostridium_orbiscindens | SPC10355 | SPC10155 | SPC10313 |
| Clostridium_symbiosum | Clostridium_tertium | Ruminococcus_gnavus | SPC10355 | SPC10155 | SPC10358 |
| Clostridium_symbiosum | Clostridium_tertium | Ruminococcus_bromii | SPC10355 | SPC10155 | SPC10468 |
| Clostridium_symbiosum | Clostridium_tertium | Blautia_sp_M25 | SPC10355 | SPC10155 | SPC10470 |
| Clostridium_symbiosum | Clostridium_disporicum | Clostridium_innocuum | SPC10355 | SPC10167 | SPC10613 |
| Clostridium_symbiosum | Clostridium_disporicum | Clostridium_mayombei | SPC10355 | SPC10167 | SPC10202 |
| Clostridium_symbiosum | Clostridium_disporicum | Clostridium_butyricum | SPC10355 | SPC10167 | SPC10238 |
| Clostridium_symbiosum | Clostridium_disporicum | Clostridium_hylemonae | SPC10355 | SPC10167 | SPC10256 |
| Clostridium_symbiosum | Clostridium_disporicum | Clostridium_orbiscindens | SPC10355 | SPC10167 | SPC10313 |
| Clostridium_symbiosum | Clostridium_disporicum | Ruminococcus_gnavus | SPC10355 | SPC10167 | SPC10358 |
| Clostridium_symbiosum | Clostridium_disporicum | Ruminococcus_bromii | SPC10355 | SPC10167 | SPC10468 |
| Clostridium_symbiosum | Clostridium_disporicum | Blautia_sp_M25 | SPC10355 | SPC10167 | SPC10470 |
| Clostridium_symbiosum | Clostridium_innocuum | Clostridium_mayombei | SPC10355 | SPC10202 | SPC10613 |
| Clostridium_symbiosum | Clostridium_innocuum | Clostridium_butyricum | SPC10355 | SPC10202 | SPC10238 |
| Clostridium_symbiosum | Clostridium_innocuum | Clostridium_hylemonae | SPC10355 | SPC10202 | SPC10256 |
| Clostridium_symbiosum | Clostridium_innocuum | Clostridium_orbiscinden | SPC10355 | SPC10202 | SPC10313 |
| Clostridium_symbiosum | Clostridium_innocuum | Ruminococcus_gnavus | SPC10355 | SPC10202 | SPC10468 |

TABLE 4a-continued

| | | | |
|---|---|---|---|
| Clostridium_symbiosum | Clostridium_innocuum | Ruminococcus_bromii | SPC10355 | SPC10202 | SPC10470 |
| Clostridium_symbiosum | Clostridium_innocuum | Blautia_sp_M25 | SPC10355 | SPC10202 | SPC10613 |
| Clostridium_symbiosum | Clostridium_mayombei | Clostridium_butyricum | SPC10355 | SPC10238 | SPC10256 |
| Clostridium_symbiosum | Clostridium_mayombei | Clostridium_hylemonae | SPC10355 | SPC10238 | SPC10313 |
| Clostridium_symbiosum | Clostridium_mayombei | Clostridium_orbiscindens | SPC10355 | SPC10238 | SPC10358 |
| Clostridium_symbiosum | Clostridium_mayombei | Ruminococcus_gnavus | SPC10355 | SPC10238 | SPC10468 |
| Clostridium_symbiosum | Clostridium_mayombei | Ruminococcus_bromii | SPC10355 | SPC10238 | SPC10470 |
| Clostridium_symbiosum | Clostridium_mayombei | Blautia_sp_M25 | SPC10355 | SPC10238 | SPC10613 |
| Clostridium_symbiosum | Clostridium_butyricum | Clostridium_hylemonae | SPC10355 | SPC10256 | SPC10313 |
| Clostridium_symbiosum | Clostridium_butyricum | Clostridium_orbiscindens | SPC10355 | SPC10256 | SPC10358 |
| Clostridium_symbiosum | Clostridium_butyricum | Ruminococcus_gnavus | SPC10355 | SPC10256 | SPC10468 |
| Clostridium_symbiosum | Clostridium_butyricum | Ruminococcus_bromii | SPC10355 | SPC10256 | SPC10470 |
| Clostridium_symbiosum | Clostridium_butyricum | Blautia_sp_M25 | SPC10355 | SPC10256 | SPC10613 |
| Clostridium_symbiosum | Clostridium_hylemonae | Clostridium_orbiscindens | SPC10355 | SPC10313 | SPC10358 |
| Clostridium_symbiosum | Clostridium_hylemonae | Ruminococcus_gnavus | SPC10355 | SPC10313 | SPC10468 |
| Clostridium_symbiosum | Clostridium_hylemonae | Ruminococcus_bromii | SPC10355 | SPC10313 | SPC10470 |
| Clostridium_symbiosum | Clostridium_hylemonae | Blautia_sp_M25 | SPC10355 | SPC10313 | SPC10613 |
| Clostridium_symbiosum | Clostridium_orbiscindens | Ruminococcus_gnavus | SPC10355 | SPC10358 | SPC10468 |
| Clostridium_symbiosum | Clostridium_orbiscindens | Ruminococcus_bromii | SPC10355 | SPC10358 | SPC10470 |
| Clostridium_symbiosum | Clostridium_orbiscindens | Blautia_sp_M25 | SPC10355 | SPC10358 | SPC10613 |
| Clostridium_symbiosum | Ruminococcus_gnavus | Ruminococcus_bromii | SPC10355 | SPC10468 | SPC10470 |
| Clostridium_symbiosum | Ruminococcus_gnavus | Blautia_sp_M25 | SPC10355 | SPC10468 | SPC10613 |
| Clostridium_symbiosum | Ruminococcus_bromii | Blautia_sp_M25 | SPC10355 | SPC10470 | SPC10613 |
| Faecalibacterium_prausnitzii | Clostridium_tertium | Clostridium_disporicum | SPC10386 | SPC10155 | SPC10167 |
| Faecalibacterium_prausnitzii | Clostridium_tertium | Clostridium_innocuum | SPC10386 | SPC10155 | SPC10202 |
| Faecalibacterium_prausnitzii | Clostridium_tertium | Clostridium_mayombei | SPC10386 | SPC10155 | SPC10238 |
| Faecalibacterium_prausnitzii | Clostridium_tertium | Clostridium_butyricum | SPC10386 | SPC10155 | SPC10256 |
| Faecalibacterium_prausnitzii | Clostridium_tertium | Clostridium_hylemonae | SPC10386 | SPC10155 | SPC10313 |
| Faecalibacterium_prausnitzii | Clostridium_tertium | Clostridium_orbiscindens | SPC10386 | SPC10155 | SPC10358 |
| Faecalibacterium_prausnitzii | Clostridium_tertium | Ruminococcus_gnavus | SPC10386 | SPC10155 | SPC10468 |
| Faecalibacterium_prausnitzii | Clostridium_tertium | Ruminococcus_bromii | SPC10386 | SPC10155 | SPC10470 |
| Faecalibacterium_prausnitzii | Clostridium_tertium | Blautia_sp_M25 | SPC10386 | SPC10155 | SPC10613 |
| Faecalibacterium_prausnitzii | Clostridium_disporicum | Clostridium_innocuum | SPC10386 | SPC10167 | SPC10202 |
| Faecalibacterium_prausnitzii | Clostridium_disporicum | Clostridium_mayombei | SPC10386 | SPC10167 | SPC10238 |
| Faecalibacterium_prausnitzii | Clostridium_disporicum | Clostridium_butyricum | SPC10386 | SPC10167 | SPC10256 |
| Faecalibacterium_prausnitzii | Clostridium_disporicum | Clostridium_hylemonae | SPC10386 | SPC10167 | SPC10313 |
| Faecalibacterium_prausnitzii | Clostridium_disporicum | Clostridium_orbiscindens | SPC10386 | SPC10167 | SPC10358 |
| Faecalibacterium_prausnitzii | Clostridium_disporicum | Ruminococcus_gnavus | SPC10386 | SPC10167 | SPC10468 |
| Faecalibacterium_prausnitzii | Clostridium_disporicum | Ruminococcus_bromii | SPC10386 | SPC10167 | SPC10470 |
| Faecalibacterium_prausnitzii | Clostridium_disporicum | Blautia_sp_M25 | SPC10386 | SPC10167 | SPC10613 |
| Faecalibacterium_prausnitzii | Clostridium_innocuum | Clostridium_mayombei | SPC10386 | SPC10202 | SPC10238 |
| Faecalibacterium_prausnitzii | Clostridium_innocuum | Clostridium_butyricum | SPC10386 | SPC10202 | SPC10256 |
| Faecalibacterium_prausnitzii | Clostridium_innocuum | Clostridium_hylemonae | SPC10386 | SPC10202 | SPC10313 |
| Faecalibacterium_prausnitzii | Clostridium_innocuum | Clostridium_orbiscindens | SPC10386 | SPC10202 | SPC10358 |
| Faecalibacterium_prausnitzii | Clostridium_innocuum | Ruminococcus_gnavus | SPC10386 | SPC10202 | SPC10468 |
| Faecalibacterium_prausnitzii | Clostridium_innocuum | Ruminococcus_bromii | SPC10386 | SPC10202 | SPC10470 |

TABLE 4a-continued

| | | | |
|---|---|---|---|
| Faecalibacterium_prausnitzii | Blautia_sp_M25 | SPC10386 | SPC10202 | SPC10613 |
| Faecalibacterium_prausnitzii | Clostridium_innocuum | SPC10386 | SPC10238 | SPC10238 |
| Faecalibacterium_prausnitzii | Clostridium_mayombei | SPC10386 | SPC10238 | SPC10256 |
| Faecalibacterium_prausnitzii | Clostridium_butyricum | SPC10386 | SPC10238 | SPC10313 |
| Faecalibacterium_prausnitzii | Clostridium_hylemonae | SPC10386 | SPC10238 | SPC10358 |
| Faecalibacterium_prausnitzii | Clostridium_orbiscindens | SPC10386 | SPC10238 | SPC10468 |
| Faecalibacterium_prausnitzii | Ruminococcus_gnavus | SPC10386 | SPC10238 | SPC10470 |
| Faecalibacterium_prausnitzii | Ruminococcus_bromii | SPC10386 | SPC10238 | SPC10613 |
| Faecalibacterium_prausnitzii | Blautia_sp_M25 | SPC10386 | SPC10256 | SPC10256 |
| Faecalibacterium_prausnitzii | Clostridium_butyricum | SPC10386 | SPC10256 | SPC10313 |
| Faecalibacterium_prausnitzii | Clostridium_hylemonae | SPC10386 | SPC10256 | SPC10358 |
| Faecalibacterium_prausnitzii | Clostridium_orbiscindens | SPC10386 | SPC10256 | SPC10468 |
| Faecalibacterium_prausnitzii | Ruminococcus_gnavus | SPC10386 | SPC10256 | SPC10470 |
| Faecalibacterium_prausnitzii | Ruminococcus_bromii | SPC10386 | SPC10256 | SPC10613 |
| Faecalibacterium_prausnitzii | Blautia_sp_M25 | SPC10386 | SPC10313 | SPC10313 |
| Faecalibacterium_prausnitzii | Clostridium_hylemonae | SPC10386 | SPC10313 | SPC10358 |
| Faecalibacterium_prausnitzii | Clostridium_orbiscindens | SPC10386 | SPC10313 | SPC10468 |
| Faecalibacterium_prausnitzii | Ruminococcus_gnavus | SPC10386 | SPC10313 | SPC10470 |
| Faecalibacterium_prausnitzii | Ruminococcus_bromii | SPC10386 | SPC10313 | SPC10613 |
| Faecalibacterium_prausnitzii | Blautia_sp_M25 | SPC10386 | SPC10358 | SPC10358 |
| Faecalibacterium_prausnitzii | Clostridium_orbiscindens | SPC10386 | SPC10358 | SPC10468 |
| Faecalibacterium_prausnitzii | Ruminococcus_gnavus | SPC10386 | SPC10358 | SPC10470 |
| Faecalibacterium_prausnitzii | Ruminococcus_bromii | SPC10386 | SPC10358 | SPC10613 |
| Faecalibacterium_prausnitzii | Clostridium_orbiscindens | SPC10386 | SPC10468 | SPC10468 |
| Faecalibacterium_prausnitzii | Ruminococcus_gnavus | SPC10386 | SPC10468 | SPC10470 |
| Faecalibacterium_prausnitzii | Ruminococcus_bromii | SPC10386 | SPC10468 | SPC10613 |
| Faecalibacterium_prausnitzii | Ruminococcus_gnavus | SPC10386 | SPC10468 | SPC10470 |
| Faecalibacterium_prausnitzii | Ruminococcus_gnavus | SPC10386 | SPC10468 | SPC10613 |
| Faecalibacterium_prausnitzii | Blautia_sp_M25 | SPC10386 | SPC10468 | SPC10613 |
| Lachnospiraceae_bacterium_5_1_57FAA | Clostridium_tertium | SPC10390 | SPC10155 | SPC10155 |
| Lachnospiraceae_bacterium_5_1_57FAA | Clostridium_disporicum | SPC10390 | SPC10155 | SPC10167 |
| Lachnospiraceae_bacterium_5_1_57FAA | Clostridium_innocuum | SPC10390 | SPC10155 | SPC10202 |
| Lachnospiraceae_bacterium_5_1_57FAA | Clostridium_mayombei | SPC10390 | SPC10155 | SPC10238 |
| Lachnospiraceae_bacterium_5_1_57FAA | Clostridium_butyricum | SPC10390 | SPC10155 | SPC10256 |
| Lachnospiraceae_bacterium_5_1_57FAA | Clostridium_hylemonae | SPC10390 | SPC10155 | SPC10313 |
| Lachnospiraceae_bacterium_5_1_57FAA | Clostridium_orbiscindens | SPC10390 | SPC10155 | SPC10358 |
| Lachnospiraceae_bacterium_5_1_57FAA | Ruminococcus_gnavus | SPC10390 | SPC10155 | SPC10468 |
| Lachnospiraceae_bacterium_5_1_57FAA | Ruminococcus_bromii | SPC10390 | SPC10155 | SPC10470 |
| Lachnospiraceae_bacterium_5_1_57FAA | Blautia_sp_M25 | SPC10390 | SPC10155 | SPC10613 |
| Lachnospiraceae_bacterium_5_1_57FAA | Clostridium_disporicum | SPC10390 | SPC10167 | SPC10167 |
| Lachnospiraceae_bacterium_5_1_57FAA | Clostridium_innocuum | SPC10390 | SPC10167 | SPC10202 |
| Lachnospiraceae_bacterium_5_1_57FAA | Clostridium_mayombei | SPC10390 | SPC10167 | SPC10238 |
| Lachnospiraceae_bacterium_5_1_57FAA | Clostridium_butyricum | SPC10390 | SPC10167 | SPC10256 |
| Lachnospiraceae_bacterium_5_1_57FAA | Clostridium_hylemonae | SPC10390 | SPC10167 | SPC10313 |
| Lachnospiraceae_bacterium_5_1_57FAA | Clostridium_orbiscindens | SPC10390 | SPC10167 | SPC10358 |
| Lachnospiraceae_bacterium_5_1_57FAA | Ruminococcus_gnavus | SPC10390 | SPC10167 | SPC10468 |
| Lachnospiraceae_bacterium_5_1_57FAA | Ruminococcus_bromii | SPC10390 | SPC10167 | SPC10470 |
| Lachnospiraceae_bacterium_5_1_57FAA | Blautia_sp_M25 | SPC10390 | SPC10167 | SPC10613 |
| Lachnospiraceae_bacterium_5_1_57FAA | Clostridium_innocuum | SPC10390 | SPC10202 | SPC10202 |
| Lachnospiraceae_bacterium_5_1_57FAA | Clostridium_mayombei | SPC10390 | SPC10202 | SPC10238 |
| Lachnospiraceae_bacterium_5_1_57FAA | Clostridium_butyricum | SPC10390 | SPC10202 | SPC10256 |
| Lachnospiraceae_bacterium_5_1_57FAA | Clostridium_hylemonae | SPC10390 | SPC10202 | SPC10313 |
| Lachnospiraceae_bacterium_5_1_57FAA | Clostridium_orbiscindens | SPC10390 | SPC10202 | SPC10358 |
| Lachnospiraceae_bacterium_5_1_57FAA | Ruminococcus_gnavus | SPC10390 | SPC10202 | SPC10468 |
| Lachnospiraceae_bacterium_5_1_57FAA | Ruminococcus_bromii | SPC10390 | SPC10202 | SPC10470 |
| Lachnospiraceae_bacterium_5_1_57FAA | Blautia_sp_M25 | SPC10390 | SPC10202 | SPC10613 |

TABLE 4a-continued

| | | | |
|---|---|---|---|
| Lachnospiraceae_bacterium_5_1_57FAA | Clostridium_mayombei | SPC10390 | SPC10238 |
| Lachnospiraceae_bacterium_5_1_57FAA | Clostridium_mayombei | SPC10390 | SPC10256 |
| Lachnospiraceae_bacterium_5_1_57FAA | Clostridium_mayombei | SPC10390 | SPC10313 |
| Lachnospiraceae_bacterium_5_1_57FAA | Clostridium_mayombei | SPC10390 | SPC10358 |
| Lachnospiraceae_bacterium_5_1_57FAA | Clostridium_mayombei | SPC10390 | SPC10468 |
| Lachnospiraceae_bacterium_5_1_57FAA | Clostridium_mayombei | SPC10390 | SPC10470 |
| Lachnospiraceae_bacterium_5_1_57FAA | Clostridium_mayombei | SPC10390 | SPC10613 |
| Lachnospiraceae_bacterium_5_1_57FAA | Clostridium_butyricum | SPC10390 | SPC10256 |
| Lachnospiraceae_bacterium_5_1_57FAA | Clostridium_butyricum | SPC10390 | SPC10313 |
| Lachnospiraceae_bacterium_5_1_57FAA | Clostridium_butyricum | SPC10390 | SPC10358 |
| Lachnospiraceae_bacterium_5_1_57FAA | Clostridium_butyricum | SPC10390 | SPC10468 |
| Lachnospiraceae_bacterium_5_1_57FAA | Clostridium_butyricum | SPC10390 | SPC10470 |
| Lachnospiraceae_bacterium_5_1_57FAA | Clostridium_butyricum | SPC10390 | SPC10613 |
| Lachnospiraceae_bacterium_5_1_57FAA | Clostridium_hylemonae | SPC10390 | SPC10313 |
| Lachnospiraceae_bacterium_5_1_57FAA | Clostridium_hylemonae | SPC10390 | SPC10358 |
| Lachnospiraceae_bacterium_5_1_57FAA | Clostridium_hylemonae | SPC10390 | SPC10468 |
| Lachnospiraceae_bacterium_5_1_57FAA | Clostridium_hylemonae | SPC10390 | SPC10470 |
| Lachnospiraceae_bacterium_5_1_57FAA | Clostridium_hylemonae | SPC10390 | SPC10613 |
| Lachnospiraceae_bacterium_5_1_57FAA | Clostridium_orbiscindens | SPC10390 | SPC10358 |
| Lachnospiraceae_bacterium_5_1_57FAA | Clostridium_orbiscindens | SPC10390 | SPC10468 |
| Lachnospiraceae_bacterium_5_1_57FAA | Clostridium_orbiscindens | SPC10390 | SPC10470 |
| Lachnospiraceae_bacterium_5_1_57FAA | Clostridium_orbiscindens | SPC10390 | SPC10613 |
| Lachnospiraceae_bacterium_5_1_57FAA | Ruminococcus_gnavus | SPC10390 | SPC10468 |
| Lachnospiraceae_bacterium_5_1_57FAA | Ruminococcus_bromii | SPC10390 | SPC10468 |
| Lachnospiraceae_bacterium_5_1_57FAA | Ruminococcus_gnavus | SPC10390 | SPC10613 |
| Lachnospiraceae_bacterium_5_1_57FAA | Blautia_sp_M25 | SPC10390 | SPC10155 |
| Blautia_producta | Clostridium_tertium | SPC10415 | SPC10155 |
| Blautia_producta | Clostridium_disporicum | SPC10415 | SPC10167 |
| Blautia_producta | Clostridium_innocuum | SPC10415 | SPC10202 |
| Blautia_producta | Clostridium_mayombei | SPC10415 | SPC10238 |
| Blautia_producta | Clostridium_butyricum | SPC10415 | SPC10256 |
| Blautia_producta | Clostridium_hylemonae | SPC10415 | SPC10313 |
| Blautia_producta | Clostridium_orbiscindens | SPC10415 | SPC10358 |
| Blautia_producta | Ruminococcus_guavus | SPC10415 | SPC10468 |
| Blautia_producta | Ruminococcus_bromii | SPC10415 | SPC10470 |
| Blautia_producta | Blautia_sp_M25 | SPC10415 | SPC10613 |
| Blautia_producta | Clostridium_innocuum | SPC10415 | SPC10167 |
| Blautia_producta | Clostridium_mayombei | SPC10415 | SPC10238 |
| Blautia_producta | Clostridium_butyricum | SPC10415 | SPC10256 |
| Blautia_producta | Clostridium_hylemonae | SPC10415 | SPC10313 |
| Blautia_producta | Clostridium_orbiscindens | SPC10415 | SPC10358 |
| Blautia_producta | Ruminococcus_guavus | SPC10415 | SPC10468 |
| Blautia_producta | Ruminococcus_bromii | SPC10415 | SPC10470 |
| Blautia_producta | Blautia_sp_M25 | SPC10415 | SPC10613 |
| Blautia_producta | Clostridium_innocuum | SPC10415 | SPC10202 |
| Blautia_producta | Clostridium_mayombei | SPC10415 | SPC10238 |
| Blautia_producta | Clostridium_butyricum | SPC10415 | SPC10256 |
| Blautia_producta | Clostridium_hylemonae | SPC10415 | SPC10313 |
| Blautia_producta | Clostridium_orbiscindens | SPC10415 | SPC10358 |
| Blautia_producta | Ruminococcus_gnavus | SPC10415 | SPC10468 |
| Blautia_producta | Ruminococcus_bromii | SPC10415 | SPC10470 |
| Blautia_producta | Blautia_sp_M25 | SPC10415 | SPC10613 |
| Blautia_producta | Clostridium_mayombei | SPC10415 | SPC10238 |

TABLE 4a-continued

| | | | |
|---|---|---|---|
| Blautia_producta | Clostridium_mayombei | Clostridium_butyricum | SPC10415 | SPC10238 | SPC10256 |
| Blautia_producta | Clostridium_mayombei | Clostridium_hylemonae | SPC10415 | SPC10238 | SPC10313 |
| Blautia_producta | Clostridium_mayombei | Clostridium_orbiscindens | SPC10415 | SPC10238 | SPC10358 |
| Blautia_producta | Clostridium_mayombei | Ruminococcus_gnavus | SPC10415 | SPC10238 | SPC10468 |
| Blautia_producta | Clostridium_mayombei | Ruminococcus_bromii | SPC10415 | SPC10238 | SPC10470 |
| Blautia_producta | Clostridium_mayombei | Blautia_sp_M25 | SPC10415 | SPC10238 | SPC10613 |
| Blautia_producta | Clostridium_butyricum | Clostridium_hylemonae | SPC10415 | SPC10256 | SPC10313 |
| Blautia_producta | Clostridium_butyricum | Clostridium_orbiscindens | SPC10415 | SPC10256 | SPC10358 |
| Blautia_producta | Clostridium_butyricum | Ruminococcus_gnavus | SPC10415 | SPC10256 | SPC10468 |
| Blautia_producta | Clostridium_butyricum | Ruminococcus_bromii | SPC10415 | SPC10256 | SPC10470 |
| Blautia_producta | Clostridium_butyricum | Blautia_sp_M25 | SPC10415 | SPC10256 | SPC10613 |
| Blautia_producta | Clostridium_hylemonae | Clostridium_orbiscindens | SPC10415 | SPC10313 | SPC10358 |
| Blautia_producta | Clostridium_hylemonae | Ruminococcus_gnavus | SPC10415 | SPC10313 | SPC10468 |
| Blautia_producta | Clostridium_hylemonae | Ruminococcus_bromii | SPC10415 | SPC10313 | SPC10470 |
| Blautia_producta | Clostridium_hylemonae | Blautia_sp_M25 | SPC10415 | SPC10313 | SPC10613 |
| Blautia_producta | Clostridium_orbiscindens | Ruminococcus_gnavus | SPC10415 | SPC10358 | SPC10468 |
| Blautia_producta | Clostridium_orbiscindens | Ruminococcus_bromii | SPC10415 | SPC10358 | SPC10470 |
| Blautia_producta | Clostridium_orbiscindens | Blautia_sp_M25 | SPC10415 | SPC10358 | SPC10613 |
| Blautia_producta | Ruminococcus_gnavus | Ruminococcus_bromii | SPC10415 | SPC10468 | SPC10470 |
| Blautia_producta | Ruminococcus_gnavus | Blautia_sp_M25 | SPC10415 | SPC10468 | SPC10613 |
| Blautia_producta | Ruminococcus_bromii | Blautia_sp_M25 | SPC10415 | SPC10470 | SPC10613 |
| Eubacterium_rectale | Clostridium_tertium | Clostridium_disporicum | SPC10567 | SPC10155 | SPC10167 |
| Eubacterium_rectale | Clostridium_tertium | Clostridium_innocuum | SPC10567 | SPC10155 | SPC10202 |
| Eubacterium_rectale | Clostridium_tertium | Clostridium_mayombei | SPC10567 | SPC10155 | SPC10238 |
| Eubacterium_rectale | Clostridium_tertium | Clostridium_butyricum | SPC10567 | SPC10155 | SPC10256 |
| Eubacterium_rectale | Clostridium_tertium | Clostridium_hylemonae | SPC10567 | SPC10155 | SPC10313 |
| Eubacterium_rectale | Clostridium_tertium | Clostridium_orbiscindens | SPC10567 | SPC10155 | SPC10358 |
| Eubacterium_rectale | Clostridium_tertium | Ruminococcus_gnavus | SPC10567 | SPC10155 | SPC10468 |
| Eubacterium_rectale | Clostridium_tertium | Ruminococcus_bromii | SPC10567 | SPC10155 | SPC10470 |
| Eubacterium_rectale | Clostridium_tertium | Blautia_sp_M25 | SPC10567 | SPC10155 | SPC10613 |
| Eubacterium_rectale | Clostridium_disporicum | Clostridium_innocuum | SPC10567 | SPC10167 | SPC10202 |
| Eubacterium_rectale | Clostridium_disporicum | Clostridium_mayombei | SPC10567 | SPC10167 | SPC10238 |
| Eubacterium_rectale | Clostridium_disporicum | Clostridium_butyricum | SPC10567 | SPC10167 | SPC10256 |
| Eubacterium_rectale | Clostridium_disporicum | Clostridium_hylemonae | SPC10567 | SPC10167 | SPC10313 |
| Eubacterium_rectale | Clostridium_disporicum | Clostridium_orbiscindens | SPC10567 | SPC10167 | SPC10358 |
| Eubacterium_rectale | Clostridium_disporicum | Ruminococcus_gnavus | SPC10567 | SPC10167 | SPC10468 |
| Eubacterium_rectale | Clostridium_disporicum | Ruminococcus_bromii | SPC10567 | SPC10167 | SPC10470 |
| Eubacterium_rectale | Clostridium_disporicum | Blautia_sp_M25 | SPC10567 | SPC10167 | SPC10613 |
| Eubacterium_rectale | Clostridium_innocuum | Clostridium_mayombei | SPC10567 | SPC10202 | SPC10238 |
| Eubacterium_rectale | Clostridium_innocuum | Clostridium_butyricum | SPC10567 | SPC10202 | SPC10256 |
| Eubacterium_rectale | Clostridium_innocuum | Clostridium_hylemonae | SPC10567 | SPC10202 | SPC10313 |
| Eubacterium_rectale | Clostridium_innocuum | Clostridium_orbiscindens | SPC10567 | SPC10202 | SPC10358 |
| Eubacterium_rectale | Clostridium_innocuum | Ruminococcus_gnavus | SPC10567 | SPC10202 | SPC10468 |
| Eubacterium_rectale | Clostridium_innocuum | Ruminococcus_bromii | SPC10567 | SPC10202 | SPC10470 |
| Eubacterium_rectale | Clostridium_innocuum | Blautia_sp_M25 | SPC10567 | SPC10202 | SPC10613 |
| Eubacterium_rectale | Clostridium_mayombei | Clostridium_butyricum | SPC10567 | SPC10238 | SPC10256 |

TABLE 4a-continued

| | | | |
|---|---|---|---|
| Eubacterium_rectale | Clostridium_mayombei | SPC10567 | SPC10238 | SPC10313 |
| Eubacterium_rectale | Clostridium_mayombei | SPC10567 | SPC10238 | SPC10358 |
| Eubacterium_rectale | Clostridium_mayombei | SPC10567 | SPC10238 | SPC10468 |
| Eubacterium_rectale | Clostridium_mayombei | SPC10567 | SPC10238 | SPC10470 |
| Eubacterium_rectale | Clostridium_mayombei | SPC10567 | SPC10238 | SPC10613 |
| Eubacterium_rectale | Clostridium_butyricum | SPC10567 | SPC10256 | SPC10256 |
| Eubacterium_rectale | Clostridium_butyricum | SPC10567 | SPC10256 | SPC10313 |
| Eubacterium_rectale | Clostridium_butyricum | SPC10567 | SPC10256 | SPC10358 |
| Eubacterium_rectale | Clostridium_butyricum | SPC10567 | SPC10256 | SPC10468 |
| Eubacterium_rectale | Clostridium_butyricum | SPC10567 | SPC10256 | SPC10470 |
| Eubacterium_rectale | Clostridium_butyricum | SPC10567 | SPC10256 | SPC10613 |
| Eubacterium_rectale | Clostridium_hylemonae | SPC10567 | SPC10313 | SPC10313 |
| Eubacterium_rectale | Clostridium_hylemonae | SPC10567 | SPC10313 | SPC10358 |
| Eubacterium_rectale | Clostridium_hylemonae | SPC10567 | SPC10313 | SPC10468 |
| Eubacterium_rectale | Clostridium_hylemonae | SPC10567 | SPC10313 | SPC10470 |
| Eubacterium_rectale | Clostridium_hylemonae | SPC10567 | SPC10313 | SPC10613 |
| Eubacterium_rectale | Clostridium_orbiscindens | SPC10567 | SPC10358 | SPC10358 |
| Eubacterium_rectale | Clostridium_orbiscindens | SPC10567 | SPC10358 | SPC10468 |
| Eubacterium_rectale | Clostridium_orbiscindens | SPC10567 | SPC10358 | SPC10470 |
| Eubacterium_rectale | Clostridium_orbiscindens | SPC10567 | SPC10358 | SPC10613 |
| Eubacterium_rectale | Ruminococcus_gnavus | SPC10567 | SPC10468 | SPC10468 |
| Eubacterium_rectale | Ruminococcus_gnavus | SPC10567 | SPC10468 | SPC10470 |
| Eubacterium_rectale | Ruminococcus_gnavus | SPC10567 | SPC10468 | SPC10613 |
| Clostridium_tertium | Collinsella_aerofaciens | SPC10155 | SPC10097 | SPC10097 |
| Clostridium_tertium | Coprococcus_comes | SPC10155 | SPC10097 | SPC10304 |
| Clostridium_tertium | Clostridium_bolteae | SPC10155 | SPC10097 | SPC10325 |
| Clostridium_tertium | Clostridium_symbiosum | SPC10155 | SPC10097 | SPC10355 |
| Clostridium_tertium | Faecalibacterium_prausnitzii | SPC10155 | SPC10097 | SPC10386 |
| Clostridium_tertium | Lachnospiraceae_bacterium_5_1_57FAA | SPC10155 | SPC10097 | SPC10390 |
| Clostridium_tertium | Blautia_producta | SPC10155 | SPC10097 | SPC10415 |
| Clostridium_tertium | Eubacterium_rectale | SPC10155 | SPC10097 | SPC10567 |
| Clostridium_tertium | Coprococcus_comes | SPC10155 | SPC10304 | SPC10304 |
| Clostridium_tertium | Clostridium_bolteae | SPC10155 | SPC10304 | SPC10325 |
| Clostridium_tertium | Clostridium_symbiosum | SPC10155 | SPC10304 | SPC10355 |
| Clostridium_tertium | Faecalibacterium_prausnitzii | SPC10155 | SPC10304 | SPC10386 |
| Clostridium_tertium | Lachnospiraceae_bacterium_5_1_57FAA | SPC10155 | SPC10304 | SPC10390 |
| Clostridium_tertium | Blautia_producta | SPC10155 | SPC10304 | SPC10415 |
| Clostridium_tertium | Eubacterium_rectale | SPC10155 | SPC10304 | SPC10567 |
| Clostridium_tertium | Clostridium_bolteae | SPC10155 | SPC10325 | SPC10325 |
| Clostridium_tertium | Clostridium_symbiosum | SPC10155 | SPC10325 | SPC10355 |
| Clostridium_tertium | Faecalibacterium_prausnitzii | SPC10155 | SPC10325 | SPC10386 |
| Clostridium_tertium | Lachnospiraceae_bacterium_5_1_57FAA | SPC10155 | SPC10325 | SPC10390 |
| Clostridium_tertium | Blautia_producta | SPC10155 | SPC10325 | SPC10415 |
| Clostridium_tertium | Eubacterium_rectale | SPC10155 | SPC10325 | SPC10567 |
| Clostridium_tertium | Clostridium_symbiosum | SPC10155 | SPC10355 | SPC10355 |
| Clostridium_tertium | Faecalibacterium_prausnitzii | SPC10155 | SPC10355 | SPC10386 |
| Clostridium_tertium | Lachnospiraceae_bacterium_5_1_57FAA | SPC10155 | SPC10355 | SPC10390 |
| Clostridium_tertium | Blautia_producta | SPC10155 | SPC10355 | SPC10415 |
| Clostridium_tertium | Eubacterium_rectale | SPC10155 | SPC10355 | SPC10567 |
| Clostridium_tertium | Faecalibacterium_prausnitzii | SPC10155 | SPC10386 | SPC10386 |
| Clostridium_tertium | Lachnospiraceae_bacterium_5_1_57FAA | SPC10155 | SPC10386 | SPC10390 |
| Clostridium_tertium | Blautia_producta | SPC10155 | SPC10386 | SPC10415 |
| Clostridium_tertium | Eubacterium_rectale | SPC10155 | SPC10386 | SPC10567 |
| Faecalibacterium_prausnitzii | Lachnospiraceae_bacterium_5_1_57FAA | SPC10155 | SPC10386 | SPC10390 |
| Faecalibacterium_prausnitzii | Blautia_producta | SPC10155 | SPC10386 | SPC10415 |
| Faecalibacterium_prausnitzii | Eubacterium_rectale | SPC10155 | SPC10386 | SPC10567 |

TABLE 4a-continued

| | | | | |
|---|---|---|---|---|
| Clostridium_tertium | Lachnospiraceae_bacterium_5_1_57FAA | Lachnospiraceae_bacterium_5_1_57FAA | SPC10155 | SPC10390 |
| Clostridium_tertium | Lachnospiraceae_bacterium_5_1_57FAA | Blautia_producta | SPC10155 | SPC10415 |
| Clostridium_tertium | Lachnospiraceae_bacterium_5_1_57FAA | Eubacterium_rectale | SPC10155 | SPC10567 |
| Clostridium_tertium | Blautia_producta | Blautia_producta | SPC10155 | SPC10415 |
| Clostridium_tertium | Blautia_producta | Eubacterium_rectale | SPC10155 | SPC10567 |
| Clostridium_tertium | Eubacterium_rectale | Eubacterium_rectale | SPC10155 | SPC10567 |
| Clostridium_disporicum | Collinsella_aerofaciens | Collinsella_aerofaciens | SPC10167 | SPC10097 |
| Clostridium_disporicum | Collinsella_aerofaciens | Coprococcus_comes | SPC10167 | SPC10304 |
| Clostridium_disporicum | Collinsella_aerofaciens | Clostridium_bolteae | SPC10167 | SPC10325 |
| Clostridium_disporicum | Collinsella_aerofaciens | Clostridium_symbiosum | SPC10167 | SPC10355 |
| Clostridium_disporicum | Collinsella_aerofaciens | Faecalibacterium_prausnitzii | SPC10367 | SPC10386 |
| Clostridium_disporicum | Collinsella_aerofaciens | Lachnospiraceae_bacterium_5_1_57FAA | SPC10167 | SPC10390 |
| Clostridium_disporicum | Collinsella_aerofaciens | Blautia_producta | SPC10167 | SPC10415 |
| Clostridium_disporicum | Collinsella_aerofaciens | Eubacterium_rectale | SPC10167 | SPC10567 |
| Clostridium_disporicum | Coprococcus_comes | Coprococcus_comes | SPC10167 | SPC10304 |
| Clostridium_disporicum | Coprococcus_comes | Clostridium_bolteae | SPC10167 | SPC10325 |
| Clostridium_disporicum | Coprococcus_comes | Clostridium_symbiosum | SPC10167 | SPC10355 |
| Clostridium_disporicum | Coprococcus_comes | Faecalibacterium_prausnitzii | SPC10167 | SPC10386 |
| Clostridium_disporicum | Coprococcus_comes | Lachnospiraceae_bacterium_5_1_57FAA | SPC10167 | SPC10390 |
| Clostridium_disporicum | Coprococcus_comes | Blautia_producta | SPC10167 | SPC10415 |
| Clostridium_disporicum | Coprococcus_comes | Eubacterium_rectale | SPC10167 | SPC10567 |
| Clostridium_disporicum | Clostridium_bolteae | Clostridium_bolteae | SPC10167 | SPC10325 |
| Clostridium_disporicum | Clostridium_bolteae | Clostridium_symbiosum | SPC10167 | SPC10355 |
| Clostridium_disporicum | Clostridium_bolteae | Faecalibacterium_prausnitzii | SPC10167 | SPC10386 |
| Clostridium_disporicum | Clostridium_bolteae | Lachnospiraceae_bacterium_5_1_57FAA | SPC10167 | SPC10390 |
| Clostridium_disporicum | Clostridium_bolteae | Blautia_producta | SPC10167 | SPC10415 |
| Clostridium_disporicum | Clostridium_bolteae | Eubacterium_rectale | SPC10167 | SPC10567 |
| Clostridium_disporicum | Clostridium_symbiosum | Clostridium_symbiosum | SPC10167 | SPC10355 |
| Clostridium_disporicum | Clostridium_symbiosum | Faecalibacterium_prausnitzii | SPC10167 | SPC10386 |
| Clostridium_disporicum | Clostridium_symbiosum | Lachnospiraceae_bacterium_5_1_57FAA | SPC10167 | SPC10390 |
| Clostridium_disporicum | Clostridium_symbiosum | Blautia_producta | SPC10167 | SPC10415 |
| Clostridium_disporicum | Clostridium_symbiosum | Eubacterium_rectale | SPC10167 | SPC10567 |
| Clostridium_disporicum | Faecalibacterium_prausnitzii | Faecalibacterium_prausnitzii | SPC10167 | SPC10386 |
| Clostridium_disporicum | Faecalibacterium_prausnitzii | Lachnospiraceae_bacterium_5_1_57FAA | SPC10167 | SPC10390 |
| Clostridium_disporicum | Faecalibacterium_prausnitzii | Blautia_producta | SPC10167 | SPC10415 |
| Clostridium_disporicum | Faecalibacterium_prausnitzii | Eubacterium_rectale | SPC10167 | SPC10567 |
| Clostridium_disporicum | Lachnospiraceae_bacterium_5_1_57FAA | Lachnospiraceae_bacterium_5_1_57FAA | SPC10167 | SPC10390 |
| Clostridium_disporicum | Lachnospiraceae_bacterium_5_1_57FAA | Blautia_producta | SPC10167 | SPC10415 |
| Clostridium_disporicum | Lachnospiraceae_bacterium_5_1_57FAA | Eubacterium_rectale | SPC10167 | SPC10567 |
| Clostridium_disporicum | Blautia_producta | Blautia_producta | SPC10167 | SPC10415 |
| Clostridium_disporicum | Blautia_producta | Eubacterium_rectale | SPC10167 | SPC10567 |
| Clostridium_disporicum | Eubacterium_rectale | Eubacterium_rectale | SPC10167 | SPC10567 |
| Clostridium_innocuum | Collinsella_aerofaciens | Collinsella_aerofaciens | SPC10202 | SPC10097 |
| Clostridium_innocuum | Collinsella_aerofaciens | Coprococcus_comes | SPC10202 | SPC10304 |
| Clostridium_innocuum | Collinsella_aerofaciens | Clostridium_bolteae | SPC10202 | SPC10325 |
| Clostridium_innocuum | Collinsella_aerofaciens | Clostridium_symbiosum | SPC10202 | SPC10355 |
| Clostridium_innocuum | Collinsella_aerofaciens | Faecalibacterium_prausnitzii | SPC10202 | SPC10386 |
| Clostridium_innocuum | Collinsella_aerofaciens | Lachnospiraceae_bacterium_5_1_57FAA | SPC10202 | SPC10390 |
| Clostridium_innocuum | Collinsella_aerofaciens | Blautia_producta | SPC10202 | SPC10415 |
| Clostridium_innocuum | Collinsella_aerofaciens | Eubacterium_rectale | SPC10202 | SPC10567 |
| Clostridium_innocuum | Coprococcus_comes | Coprococcus_comes | SPC10202 | SPC10304 |
| Clostridium_innocuum | Coprococcus_comes | Clostridium_bolteae | SPC10202 | SPC10325 |
| Clostridium_innocuum | Coprococcus_comes | Clostridium_symbiosum | SPC10202 | SPC10355 |

TABLE 4a-continued

| | | | |
|---|---|---|---|
| Clostridium_innocuum | Coprococcus_comes | Faecalibacterium_prausnitzii | SPC10304 | SPC10386 |
| Clostridium_innocuum | Coprococcus_comes | Lachnospiraceae_bacterium_5_1_57FAA | SPC10304 | SPC10390 |
| Clostridium_innocuum | Coprococcus_comes | Blautia_producta | SPC10304 | SPC10415 |
| Clostridium_innocuum | Coprococcus_comes | Eubacterium_rectale | SPC10304 | SPC10567 |
| Clostridium_innocuum | Clostridium_bolteae | Clostridium_symbiosum | SPC10325 | SPC10355 |
| Clostridium_innocuum | Clostridium_bolteae | Faecalibacterium_prausnitzii | SPC10325 | SPC10386 |
| Clostridium_innocuum | Clostridium_bolteae | Lachnospiraceae_bacterium_5_1_57FAA | SPC10325 | SPC10390 |
| Clostridium_innocuum | Clostridium_bolteae | Blautia_producta | SPC10325 | SPC10415 |
| Clostridium_innocuum | Clostridium_bolteae | Eubacterium_rectale | SPC10325 | SPC10567 |
| Clostridium_innocuum | Clostridium_symbiosum | Faecalibacterium_prausnitzii | SPC10355 | SPC10386 |
| Clostridium_innocuum | Clostridium_symbiosum | Lachnospiraceae_bacterium_5_1_57FAA | SPC10355 | SPC10390 |
| Clostridium_innocuum | Clostridium_symbiosum | Blautia_producta | SPC10355 | SPC10415 |
| Clostridium_innocuum | Clostridium_symbiosum | Eubacterium_rectale | SPC10355 | SPC10567 |
| Clostridium_innocuum | Faecalibacterium_prausnitzii | Lachnospiraceae_bacterium_5_1_57FAA | SPC10386 | SPC10390 |
| Clostridium_innocuum | Faecalibacterium_prausnitzii | Blautia_producta | SPC10386 | SPC10415 |
| Clostridium_innocuum | Faecalibacterium_prausnitzii | Eubacterium_rectale | SPC10386 | SPC10567 |
| Clostridium_innocuum | Lachnospiraceae_bacterium_5_1_57FAA | Blautia_producta | SPC10390 | SPC10415 |
| Clostridium_innocuum | Lachnospiraceae_bacterium_5_1_57FAA | Eubacterium_rectale | SPC10390 | SPC10567 |
| Clostridium_innocuum | Blautia_producta | Eubacterium_rectale | SPC10415 | SPC10567 |
| Clostridium_mayombei | Collinsella_aerofaciens | Eubacterium_rectale | SPC10202 | SPC10567 |
| Clostridium_mayombei | Collinsella_aerofaciens | Coprococcus_comes | SPC10238 | SPC10097 |
| Clostridium_mayombei | Collinsella_aerofaciens | Clostridium_bolteae | SPC10238 | SPC10097 |
| Clostridium_mayombei | Collinsella_aerofaciens | Clostridium_symbiosum | SPC10238 | SPC10097 |
| Clostridium_mayombei | Collinsella_aerofaciens | Faecalibacterium_prausnitzii | SPC10238 | SPC10097 |
| Clostridium_mayombei | Collinsella_aerofaciens | Lachnospiraceae_bacterium_5_1_57FAA | SPC10238 | SPC10097 |
| Clostridium_mayombei | Collinsella_aerofaciens | Blautia_producta | SPC10238 | SPC10097 |
| Clostridium_mayombei | Collinsella_aerofaciens | Eubacterium_rectale | SPC10238 | SPC10097 |
| Clostridium_mayombei | Coprococcus_comes | Clostridium_bolteae | SPC10238 | SPC10304 |
| Clostridium_mayombei | Coprococcus_comes | Clostridium_symbiosum | SPC10238 | SPC10304 |
| Clostridium_mayombei | Coprococcus_comes | Faecalibacterium_prausnitzii | SPC10238 | SPC10304 |
| Clostridium_mayombei | Coprococcus_comes | Lachnospiraceae_bacterium_5_1_57FAA | SPC10238 | SPC10304 |
| Clostridium_mayombei | Coprococcus_comes | Blautia_producta | SPC10238 | SPC10304 |
| Clostridium_mayombei | Coprococcus_comes | Eubacterium_rectale | SPC10238 | SPC10304 |
| Clostridium_mayombei | Clostridium_bolteae | Clostridium_symbiosum | SPC10238 | SPC10325 |
| Clostridium_mayombei | Clostridium_bolteae | Faecalibacterium_prausnitzii | SPC10238 | SPC10325 |
| Clostridium_mayombei | Clostridium_bolteae | Lachnospiraceae_bacterium_5_1_57FAA | SPC10238 | SPC10325 |
| Clostridium_mayombei | Clostridium_bolteae | Blautia_producta | SPC10238 | SPC10325 |
| Clostridium_mayombei | Clostridium_bolteae | Eubacterium_rectale | SPC10238 | SPC10325 |
| Clostridium_mayombei | Clostridium_symbiosum | Faecalibacterium_prausnitzii | SPC10238 | SPC10355 |
| Clostridium_mayombei | Clostridium_symbiosum | Lachnospiraceae_bacterium_5_1_57FAA | SPC10238 | SPC10355 |
| Clostridium_mayombei | Clostridium_symbiosum | Blautia_producta | SPC10238 | SPC10355 |
| Clostridium_mayombei | Clostridium_symbiosum | Eubacterium_rectale | SPC10238 | SPC10355 |
| Clostridium_mayombei | Faecalibacterium_prausnitzii | Lachnospiraceae_bacterium_5_1_57FAA | SPC10238 | SPC10386 |
| Clostridium_mayombei | Faecalibacterium_prausnitzii | Lachnospiraceae_bacterium_5_1_57FAA | SPC10238 | SPC10390 |

TABLE 4a-continued

| | | | | | |
|---|---|---|---|---|---|
| Clostridium__mayombei | Faecalibacterium__prausnitzii | Blautia__producta | SPC10238 | SPC10386 | SPC10415 |
| Closiridium__mayombei | Faecalibacterium__prausnitzii | Eubacterium__rectale | SPC10238 | SPC10386 | SPC10567 |
| Clostridium__mayombei | Lachnospiraceae__bacterium__5__1__57FAA | Lachnospiraceae__bacterium__5__1__57FAA | SPC10238 | SPC10390 | SPC10390 |
| Clostridium__mayombei | Lachnospiraceae__bacterium__5__1__57FAA | Blautia__producta | SPC10238 | SPC10390 | SPC10415 |
| Clostridium__mayombei | Lachnospiraceae__bacterium__5__1__57FAA | Eubacterium__rectale | SPC10238 | SPC10390 | SPC10567 |
| Clostridium__mayombei | Blautia__producta | Blautia__producta | SPC10238 | SPC10415 | SPC10415 |
| Clostridium__mayombei | Blautia__producta | Eubacterium__rectale | SPC10238 | SPC10415 | SPC10567 |
| Clostridium__mayombei | Eubacterium__rectale | Eubacterium__rectale | SPC10238 | SPC10567 | SPC10567 |
| Clostridium__butyricum | Collinsella__aerofaciens | Collinsella__aerofaciens | SPC10256 | SPC10097 | SPC10097 |
| Clostridium__butyricum | Collinsella__aerofaciens | Coprococcus__comes | SPC10256 | SPC10097 | SPC10304 |
| Clostridium__butyricum | Collinsella__aerofaciens | Clostridium__bolteae | SPC10256 | SPC10097 | SPC10325 |
| Clostridium__butyricum | Collinsella__aerofaciens | Clostridium__symbiosum | SPC10256 | SPC10097 | SPC10355 |
| Clostridium__butyricum | Collinsella__aerofaciens | Faecalibacterium__prausnitzii | SPC10256 | SPC10097 | SPC10386 |
| Clostridium__butyricum | Collinsella__aerofaciens | Lachnospiraceae__bacterium__5__1__57FAA | SPC10256 | SPC10097 | SPC10390 |
| Clostridium__butyricum | Collinsella__aerofaciens | Blautia__producta | SPC10256 | SPC10097 | SPC10415 |
| Clostridium__butyricum | Collinsella__aerofaciens | Eubacterium__rectale | SPC10256 | SPC10097 | SPC10567 |
| Clostridium__butyricum | Coprococcus__comes | Coprococcus__comes | SPC10256 | SPC10304 | SPC10304 |
| Clostridium__butyricum | Coprococcus__comes | Clostridium__bolteae | SPC10256 | SPC10304 | SPC10325 |
| Clostridium__butyricum | Coprococcus__comes | Clostridium__symbiosum | SPC10256 | SPC10304 | SPC10355 |
| Clostridium__butyricum | Coprococcus__comes | Faecalibacterium__prausnitzii | SPC10256 | SPC10304 | SPC10386 |
| Clostridium__butyricum | Coprococcus__comes | Lachnospiraceae__bacterium__5__1__57FAA | SPC10256 | SPC10304 | SPC10390 |
| Clostridium__butyricum | Coprococcus__comes | Blautia__producta | SPC10256 | SPC10304 | SPC10415 |
| Clostridium__butyricum | Coprococcus__comes | Eubacterium__rectale | SPC10256 | SPC10304 | SPC10567 |
| Clostridium__butyricum | Clostridium__bolteae | Clostridium__bolteae | SPC10256 | SPC10325 | SPC10325 |
| Clostridium__butyricum | Clostridium__bolteae | Clostridium__symbiosum | SPC10256 | SPC10325 | SPC10355 |
| Clostridium__butyricum | Clostridium__bolteae | Faecalibacterium__prausnitzii | SPC10256 | SPC10325 | SPC10386 |
| Clostridium__butyricum | Clostridium__bolteae | Lachnospiraceae__bacterium__5__1__57FAA | SPC10256 | SPC10325 | SPC10390 |
| Clostridium__butyricum | Clostridium__bolteae | Blautia__producta | SPC10256 | SPC10325 | SPC10415 |
| Clostridium__butyricum | Clostridium__bolteae | Eubacterium__rectale | SPC10256 | SPC10325 | SPC10567 |
| Clostridium__butyricum | Clostridium__symbiosum | Clostridium__symbiosum | SPC10256 | SPC10355 | SPC10355 |
| Clostridium__butyricum | Clostridium__symbiosum | Faecalibacterium__prausnitzii | SPC10256 | SPC10355 | SPC10386 |
| Clostridium__butyricum | Clostridium__symbiosum | Lachnospiraceae__bacterium__5__1__57FAA | SPC10256 | SPC10355 | SPC10390 |
| Clostridium__butyricum | Clostridium__symbiosum | Blautia__producta | SPC10256 | SPC10355 | SPC10415 |
| Clostridium__butyricum | Clostridium__symbiosum | Eubacterium__rectale | SPC10256 | SPC10355 | SPC10567 |
| Clostridium__butyricum | Faecalibacterium__prausnitzii | Faecalibacterium__prausnitzii | SPC10256 | SPC10386 | SPC10386 |
| Clostridium__butyricum | Faecalibacterium__prausnitzii | Lachnospiraceae__bacterium__5__1__57FAA | SPC10256 | SPC10386 | SPC10390 |
| Clostridium__butyricum | Faecalibacterium__prausnitzii | Blautia__producta | SPC10256 | SPC10386 | SPC10415 |
| Clostridium__butyricum | Faecalibacterium__prausnitzii | Eubacterium__rectale | SPC10256 | SPC10386 | SPC10567 |
| Clostridium__butyricum | Lachnospiraceae__bacterium__5__1__57FAA | Lachnospiraceae__bacterium__5__1__57FAA | SPC10256 | SPC10390 | SPC10390 |
| Clostridium__butyricum | Lachnospiraceae__bacterium__5__1__57FAA | Blautia__producta | SPC10256 | SPC10390 | SPC10415 |
| Clostridium__butyricum | Lachnospiraceae__bacterium__5__1__57FAA | Eubacterium__rectale | SPC10256 | SPC10390 | SPC10567 |
| Clostridium__butyricum | Blautia__producta | Blautia__producta | SPC10256 | SPC10415 | SPC10415 |
| Clostridium__butyricum | Blautia__producta | Eubacterium__rectale | SPC10256 | SPC10415 | SPC10567 |
| Clostridium__butyricum | Eubacterium__rectale | Eubacterium__rectale | SPC10256 | SPC10567 | SPC10567 |
| Clostridium__hylemonae | Collinsella__aerofaciens | Collinsella__aerofaciens | SPC10313 | SPC10097 | SPC10097 |
| Clostridium__hylemonae | Collinsella__aerofaciens | Coprococcus__comes | SPC10313 | SPC10097 | SPC10304 |
| Clostridium__hylemonae | Collinsella__aerofaciens | Clostridium__bolteae | SPC10313 | SPC10097 | SPC10325 |
| Clostridium__hylemonae | Collinsella__aerofaciens | Clostridium__symbiosum | SPC10313 | SPC10097 | SPC10355 |
| Clostridium__hylemonae | Collinsella__aerofaciens | Faecalibacterium__prausnitzii | SPC10313 | SPC10097 | SPC10386 |
| Clostridium__hylemonae | Collinsella__aerofaciens | Lachnospiraceae__bacterium__5__1__57FAA | SPC10313 | SPC10097 | SPC10390 |
| Clostridium__hylemonae | Collinsella__aerofaciens | Blautia__producta | SPC10313 | SPC10097 | SPC10415 |
| Clostridium__hylemonae | Collinsella__aerofaciens | Eubacterium__rectale | SPC10313 | SPC10097 | SPC10567 |
| Clostridium__hylemonae | Coprococcus__comes | Coprococcus__comes | SPC10313 | SPC10304 | SPC10304 |

| | | | |
|---|---|---|---|
| Clostridium_hylemonae | Coprococcus_comes | Clostridium_bolteae | SPC10313 | SPC10304 | SPC10325 |
| Clostridium_hylemonae | Coprococcus_comes | Clostridium_symbiosum | SPC10313 | SPC10304 | SPC10355 |
| Clostridium_hylemonae | Coprococcus_comes | Faecalibacterium_prausnitzii | SPC10313 | SPC10304 | SPC10386 |
| Clostridium_hylemonae | Coprococcus_comes | Lachnospiraceae_bacterium_5_1_57FAA | SPC10313 | SPC10304 | SPC10390 |
| Clostridium_hylemonae | Coprococcus_comes | Blautia_producta | SPC10313 | SPC10304 | SPC10415 |
| Clostridium_hylemonae | Coprococcus_comes | Eubacterium_rectale | SPC10313 | SPC10304 | SPC10567 |
| Clostridium_hylemonae | Clostridium_bolteae | Clostridium_symbiosum | SPC10313 | SPC10325 | SPC10355 |
| Clostridium_hylemonae | Clostridium_bolteae | Faecalibacterium_prausnitzii | SPC10313 | SPC10325 | SPC10386 |
| Clostridium_hylemonae | Clostridium_bolteae | Lachnospiraceae_bacterium_5_1_57FAA | SPC10313 | SPC10325 | SPC10390 |
| Clostridium_hylemonae | Clostridium_bolteae | Blautia_producta | SPC10313 | SPC10325 | SPC10415 |
| Clostridium_hylemonae | Clostridium_bolteae | Eubacterium_rectale | SPC10313 | SPC10325 | SPC10567 |
| Clostridium_hylemonae | Clostridium_symbiosum | Faecalibacterium_prausnitzii | SPC10313 | SPC10355 | SPC10386 |
| Clostridium_hylemonae | Clostridium_symbiosum | Lachnospiraceae_bacterium_5_1_57FAA | SPC10313 | SPC10355 | SPC10390 |
| Clostridium_hylemonae | Clostridium_symbiosum | Blautia_producta | SPC10313 | SPC10355 | SPC10415 |
| Clostridium_hylemonae | Clostridium_symbiosum | Eubacterium_rectale | SPC10313 | SPC10355 | SPC10567 |
| Clostridium_hylemonae | Faecalibacterium_prausnitzii | Lachnospiraceae_bacterium_5_1_57FAA | SPC10313 | SPC10386 | SPC10390 |
| Clostridium_hylemonae | Faecalibacterium_prausnitzii | Blautia_producta | SPC10313 | SPC10386 | SPC10415 |
| Clostridium_hylemonae | Faecalibacterium_prausnitzii | Eubacterium_rectale | SPC10313 | SPC10386 | SPC10567 |
| Clostridium_hylemonae | Lachnospiraceae_bacterium_5_1_57FAA | Blautia_producta | SPC10313 | SPC10390 | SPC10415 |
| Clostridium_hylemonae | Lachnospiraceae_bacterium_5_1_57FAA | Eubacterium_rectale | SPC10313 | SPC10390 | SPC10567 |
| Clostridium_hylemonae | Blautia_producta | Eubacterium_rectale | SPC10313 | SPC10415 | SPC10567 |
| Clostridium_orbiscindens | Collinsella_aerofaciens | Coprococcus_comes | SPC10358 | SPC10097 | SPC10304 |
| Clostridium_orbiscindens | Collinsella_aerofaciens | Clostridium_bolteae | SPC10358 | SPC10097 | SPC10325 |
| Clostridium_orbiscindens | Collinsella_aerofaciens | Clostridium_symbiosum | SPC10358 | SPC10097 | SPC10355 |
| Clostridium_orbiscindens | Collinsella_aerofaciens | Faecalibacterium_prausnitzii | SPC10358 | SPC10097 | SPC10386 |
| Clostridium_orbiscindens | Collinsella_aerofaciens | Lachnospiraceae_bacterium_5_1_57FAA | SPC10358 | SPC10097 | SPC10390 |
| Clostridium_orbiscindens | Collinsella_aerofaciens | Blautia_producta | SPC10358 | SPC10097 | SPC10415 |
| Clostridium_orbiscindens | Collinsella_aerofaciens | Eubacterium_rectale | SPC10358 | SPC10097 | SPC10567 |
| Clostridium_orbiscindens | Coprococcus_comes | Clostridium_bolteae | SPC10358 | SPC10304 | SPC10325 |
| Clostridium_orbiscindens | Coprococcus_comes | Clostridium_symbiosum | SPC10358 | SPC10304 | SPC10355 |
| Clostridium_orbiscindens | Coprococcus_comes | Faecalibacterium_prausnitzii | SPC10358 | SPC10304 | SPC10386 |
| Clostridium_orbiscindens | Coprococcus_comes | Lachnospiraceae_bacterium_5_1_57FAA | SPC10358 | SPC10304 | SPC10390 |
| Clostridium_orbiscindens | Coprococcus_comes | Blautia_producta | SPC10358 | SPC10304 | SPC10415 |
| Clostridium_orbiscindens | Coprococcus_comes | Eubacterium_rectale | SPC10358 | SPC10304 | SPC10567 |
| Clostridium_orbiscindens | Clostridium_bolteae | Clostridium_symbiosum | SPC10358 | SPC10325 | SPC10355 |
| Clostridium_orbiscindens | Clostridium_bolteae | Faecalibacterium_prausnitzii | SPC10358 | SPC10325 | SPC10386 |
| Clostridium_orbiscindens | Clostridium_bolteae | Lachnospiraceae_bacterium_5_1_57FAA | SPC10358 | SPC10325 | SPC10390 |
| Clostridium_orbiscindens | Clostridium_bolteae | Blautia_producta | SPC10358 | SPC10325 | SPC10415 |
| Clostridium_orbiscindens | Clostridium_bolteae | Eubacterium_rectale | SPC10358 | SPC10325 | SPC10567 |
| Clostridium_orbiscindens | Clostridium_symbiosum | Faecalibacterium_prausnitzii | SPC10358 | SPC10355 | SPC10386 |
| Clostridium_orbiscindens | Clostridium_symbiosum | Lachnospiraceae_bacterium_5_1_57FAA | SPC10358 | SPC10355 | SPC10390 |
| Clostridium_orbiscindens | Clostridium_symbiosum | Blautia_producta | SPC10358 | SPC10355 | SPC10415 |
| Clostridium_orbiscindens | Clostridium_symbiosum | Eubacterium_rectale | SPC10358 | SPC10355 | SPC10567 |

TABLE 4a-continued

| | | | |
|---|---|---|---|
| Clostridium_orbiscindens | Faecalibacterium_prausnitzii | Faecalibacterium_prausnitzii | SPC10358 | SPC10386 |
| Clostridium_orbiscindens | Faecalibacterium_prausnitzii | Lachnospiraceae_bacterium_5_1_57FAA | SPC10358 | SPC10390 |
| Clostridium_orbiscindens | Faecalibacterium_prausnitzii | Blautia_producta | SPC10358 | SPC10415 |
| Clostridium_orbiscindens | Faecalibacterium_prausnitzii | Eubacterium_rectale | SPC10358 | SPC10567 |
| Clostridium_orbiscindens | Lachnospiraceae_bacterium_5_1_57FAA | Lachnospiraceae_bacterium_5_1_57FAA | SPC10358 | SPC10390 |
| Clostridium_orbiscindens | Lachnospiraceae_bacterium_5_1_57FAA | Blautia_producta | SPC10358 | SPC10415 |
| Clostridium_orbiscindens | Lachnospiraceae_bacterium_5_1_57FAA | Eubacterium_rectale | SPC10358 | SPC10567 |
| Clostridium_orbiscindens | Blautia_producta | Blautia_producta | SPC10358 | SPC10415 |
| Clostridium_orbiscindens | Blautia_producta | Eubacterium_rectale | SPC10358 | SPC10567 |
| Clostridium_orbiscindens | Eubacterium_rectale | Eubacterium_rectale | SPC10358 | SPC10567 |
| Ruminococcus_gnavus | Collinsella_aerofaciens | Collinsella_aerofaciens | SPC10468 | SPC10097 |
| Ruminococcus_gnavus | Collinsella_aerofaciens | Coprococcus_comes | SPC10468 | SPC10097 |
| Ruminococcus_gnavus | Collinsella_aerofaciens | Clostridium_bolteae | SPC10468 | SPC10097 |
| Ruminococcus_gnavus | Collinsella_aerofaciens | Clostridium_symbiosum | SPC10468 | SPC10097 |
| Ruminococcus_gnavus | Collinsella_aerofaciens | Faecalibacterium_prausnitzii | SPC10468 | SPC10097 |
| Ruminococcus_gnavus | Collinsella_aerofaciens | Lachnospiraceae_bacterium_5_1_57FAA | SPC10468 | SPC10097 |
| Ruminococcus_gnavus | Collinsella_aerofaciens | Blautia_producta | SPC10468 | SPC10097 |
| Ruminococcus_gnavus | Collinsella_aerofaciens | Eubacterium_rectale | SPC10468 | SPC10097 |
| Ruminococcus_gnavus | Coprococcus_comes | Coprococcus_comes | SPC10468 | SPC10304 |
| Ruminococcus_gnavus | Coprococcus_comes | Clostridium_bolteae | SPC10468 | SPC10304 |
| Ruminococcus_gnavus | Coprococcus_comes | Clostridium_symbiosum | SPC10468 | SPC10304 |
| Ruminococcus_gnavus | Coprococcus_comes | Faecalibacterium_prausnitzii | SPC10468 | SPC10304 |
| Ruminococcus_gnavus | Coprococcus_comes | Lachnospiraceae_bacterium_5_1_57FAA | SPC10468 | SPC10304 |
| Ruminococcus_gnavus | Coprococcus_comes | Blautia_producta | SPC10468 | SPC10304 |
| Ruminococcus_gnavus | Coprococcus_comes | Eubacterium_rectale | SPC10468 | SPC10304 |
| Ruminococcus_gnavus | Clostridium_bolteae | Clostridium_bolteae | SPC10468 | SPC10325 |
| Ruminococcus_gnavus | Clostridium_bolteae | Clostridium_symbiosum | SPC10468 | SPC10325 |
| Ruminococcus_gnavus | Clostridium_bolteae | Faecalibacterium_prausnitzii | SPC10468 | SPC10325 |
| Ruminococcus_gnavus | Clostridium_bolteae | Lachnospiraceae_bacterium_5_1_57FAA | SPC10468 | SPC10325 |
| Ruminococcus_gnavus | Clostridium_bolteae | Blautia_producta | SPC10468 | SPC10325 |
| Ruminococcus_gnavus | Clostridium_bolteae | Eubacterium_rectale | SPC10468 | SPC10325 |
| Ruminococcus_gnavus | Clostridium_symbiosum | Clostridium_symbiosum | SPC10468 | SPC10355 |
| Ruminococcus_gnavus | Clostridium_symbiosum | Faecalibacterium_prausnitzii | SPC10468 | SPC10355 |
| Ruminococcus_gnavus | Clostridium_symbiosum | Lachnospiraceae_bacterium_5_1_57FAA | SPC10468 | SPC10355 |
| Ruminococcus_gnavus | Clostridium_symbiosum | Blautia_producta | SPC10468 | SPC10355 |
| Ruminococcus_gnavus | Clostridium_symbiosum | Eubacterium_rectale | SPC10468 | SPC10355 |
| Ruminococcus_gnavus | Faecalibacterium_prausnitzii | Faecalibacterium_prausnitzii | SPC10468 | SPC10386 |
| Ruminococcus_gnavus | Faecalibacterium_prausnitzii | Lachnospiraceae_bacterium_5_1_57FAA | SPC10468 | SPC10386 |
| Ruminococcus_gnavus | Faecalibacterium_prausnitzii | Blautia_producta | SPC10468 | SPC10386 |
| Ruminococcus_gnavus | Faecalibacterium_prausnitzii | Eubacterium_rectale | SPC10468 | SPC10386 |
| Ruminococcus_gnavus | Lachnospiraceae_bacterium_5_1_57FAA | Lachnospiraceae_bacterium_5_1_57FAA | SPC10468 | SPC10390 |
| Ruminococcus_gnavus | Lachnospiraceae_bacterium_5_1_57FAA | Blautia_producta | SPC10468 | SPC10390 |
| Ruminococcus_gnavus | Lachnospiraceae_bacterium_5_1_57FAA | Eubacterium_rectale | SPC10468 | SPC10390 |
| Ruminococcus_gnavus | Blautia_producta | Blautia_producta | SPC10468 | SPC10415 |
| Ruminococcus_gnavus | Blautia_producta | Eubacterium_rectale | SPC10468 | SPC10415 |
| Ruminococcus_gnavus | Eubacterium_rectale | Eubacterium_rectale | SPC10468 | SPC10567 |

TABLE 4a-continued

| OTU1 of Composition | Clade of OTU1 | Clade of OTU2 | Clade of OTU3 (if applicable) | Hetero/ Semi/Homo | C. diff Inhibition Score | 75th Percentile of C. diff Inhibition Score | C. diff Inhibition Synergy | VRE Inhibition Score | 75th Percentile of VRE Inhibition Score |
|---|---|---|---|---|---|---|---|---|---|
| Escherichia_coli | clade_92 | clade_92 | | homo | +++ | FALSE | TRUE | | |
| Escherichia_coli | clade_92 | clade_378 | | hetero | ++++ | FALSE | TRUE | | |
| Escherichia_coli | clade_92 | clade_65 | | hetero | ++++ | TRUE | TRUE | | |
| Escherichia_coli | clade_92 | clade_38 | | hetero | ++++ | TRUE | TRUE | | |
| Escherichia_coli | clade_92 | clade_497 | | hetero | ++++ | TRUE | TRUE | | |
| Escherichia_coli | clade_92 | clade_481 | | hetero | + | FALSE | TRUE | | |
| Escherichia_coli | clade_92 | clade_98 | | hetero | + | FALSE | FALSE | | |
| Escherichia_coli | clade_92 | clade_360 | | hetero | + | FALSE | TRUE | | |
| Escherichia_coli | clade_92 | clade_309 | | hetero | ++++ | FALSE | FALSE | | |
| Escherichia_coli | clade_92 | clade_522 | | hetero | + | FALSE | TRUE | | |
| Escherichia_coli | clade_92 | clade_262 | | hetero | ++++ | TRUE | TRUE | | |
| Escherichia_coli | clade_92 | clade_351 | | hetero | ++++ | FALSE | TRUE | | |
| Escherichia_coli | clade_92 | clade_478 | | hetero | ++++ | TRUE | TRUE | | |
| Escherichia_coli | clade_92 | clade_466 | | hetero | ++++ | TRUE | TRUE | | |
| Escherichia_coli | clade_92 | clade_360 | | hetero | ++++ | TRUE | TRUE | | |
| Escherichia_coli | clade_92 | clade_444 | | hetero | ++++ | FALSE | TRUE | | |
| Escherichia_coli | clade_92 | clade_393 | | hetero | ++++ | FALSE | TRUE | | |
| Escherichia_coli | clade_92 | clade_479 | | hetero | ++++ | FALSE | TRUE | | |
| Escherichia_coli | clade_92 | clade_110 | | hetero | ++++ | TRUE | TRUE | | |
| Escherichia_coli | clade_92 | clade_38 | | hetero | ++++ | TRUE | TRUE | | |
| Escherichia_coli | clade_92 | clade_286 | | hetero | +++ | FALSE | FALSE | | |
| Escherichia_coli | clade_92 | clade_408 | | hetero | ++++ | FALSE | TRUE | | |
| Escherichia_coli | clade_92 | clade_553 | | hetero | +++ | TRUE | TRUE | | |
| Escherichia_coli | clade_92 | clade_92 | | hetero | +++ | FALSE | TRUE | | |
| Escherichia_coli | clade_92 | clade_309 | | hetero | +++ | FALSE | FALSE | | |
| Escherichia_coli | clade_92 | clade_170 | | hetero | ++++ | FALSE | FALSE | | |
| Escherichia_coli | clade_92 | clade_85 | | hetero | ++++ | TRUE | TRUE | | |
| Escherichia_coli | clade_92 | clade_262 | | hetero | ++++ | TRUE | TRUE | | |
| Escherichia_coli | clade_92 | clade_408 | | hetero | ++++ | FALSE | FALSE | | |
| Escherichia_coli | clade_92 | clade_172 | | hetero | ++++ | FALSE | FALSE | | |
| Escherichia_coli | clade_92 | clade_478 | | hetero | +++ | TRUE | TRUE | | |
| Escherichia_coli | clade_92 | clade_262 | | hetero | ++++ | TRUE | TRUE | | |
| Escherichia_coli | clade_92 | clade_408 | | hetero | ++++ | TRUE | TRUE | | |
| Escherichia_coli | clade_92 | clade_444 | | hetero | ++++ | FALSE | TRUE | | |
| Escherichia_coli | clade_92 | clade_172 | | hetero | ++++ | FALSE | TRUE | | |
| Escherichia_coli | clade_92 | clade_466 | | hetero | +++ | FALSE | TRUE | | |
| Escherichia_coli | clade_92 | clade_260 | | hetero | ++++ | TRUE | TRUE | | |
| Escherichia_coli | clade_92 | clade_481 | | hetero | + | FALSE | TRUE | | |
| Escherichia_coli | clade_92 | clade_98 | | hetero | + | FALSE | TRUE | | |
| Escherichia_coli | clade_92 | clade_500 | | hetero | +++++ | FALSE | TRUE | | |
| Escherichia_coli | clade_92 | clade_309 | | hetero | ++++ | FALSE | FALSE | | |
| Bacteroides_vulgatus | clade_378 | clade_378 | | homo | +++ | FALSE | | | |
| Bacteroides_vulgatus | clade_378 | clade_65 | | hetero | +++ | FALSE | TRUE | | |
| Bacteroides_vulgatus | clade_378 | clade_38 | | hetero | ++++ | FALSE | TRUE | | |
| Bacteroides_vulgatus | clade_378 | clade_497 | | hetero | ++++ | TRUE | TRUE | | |
| Bacteroides_vulgatus | clade_378 | clade_481 | | hetero | + | FALSE | TRUE | | |
| Bacteroides_vulgatus | clade_378 | clade_98 | | hetero | + | FALSE | TRUE | | |
| Bacteroides_vulgatus | clade_378 | clade_360 | | hetero | +++ | FALSE | TRUE | | |
| Bacteroides_vulgatus | clade_378 | clade_309 | | hetero | ++++ | TRUE | TRUE | | |

TABLE 4a-continued

| | | | | | |
|---|---|---|---|---|---|
| Bacteroides_vulgatus | clade_378 | clade_522 | hetero | ++ | FALSE | TRUE |
| Bacteroides_vulgatus | clade_378 | clade_262 | hetero | +++ | FALSE | TRUE |
| Bacteroides_vulgatus | clade_378 | clade_351 | hetero | + | FALSE | FALSE |
| Bacteroides_vulgatus | clade_378 | clade_478 | hetero | +++ | FALSE | TRUE |
| Bacteroides_vulgatus | clade_378 | clade_466 | hetero | ++ | FALSE | TRUE |
| Bacteroides_vulgatus | clade_378 | clade_360 | hetero | ++++ | FALSE | TRUE |
| Bacteroides_vulgatus | clade_378 | clade_444 | hetero | + | FALSE | TRUE |
| Bacteroides_vulgatus | clade_378 | clade_393 | hetero | | FALSE | TRUE |
| Bacteroides_vulgatus | clade_378 | clade_479 | hetero | | FALSE | TRUE |
| Bacteroides_vulgatus | clade_378 | clade_110 | hetero | | FALSE | TRUE |
| Bacteroides_vulgatus | clade_378 | clade_38 | hetero | | FALSE | FALSE |
| Bacteroides_vulgatus | clade_378 | clade_286 | hetero | ++++ | FALSE | TRUE |
| Bacteroides_vulgatus | clade_378 | clade_378 | hetero | +, | TRUE | TRUE |
| Bacteroides_vulgatus | clade_378 | clade_553 | hetero | ++++ | FALSE | TRUE |
| Bacteroides_vulgatus | clade_378 | clade_92 | hetero | ++++ | FALSE | TRUE |
| Bacteroides_vulgatus | clade_378 | clade_309 | hetero | ++++ | TRUE | TRUE |
| Bacteroides_vulgatus | clade_378 | clade_170 | hetero | ++++ | TRUE | TRUE |
| Bacteroides_vulgatus | clade_378 | clade_85 | hetero | ++++ | TRUE | TRUE |
| Bacteroides_vulgatus | clade_378 | clade_262 | hetero | ++++ | FALSE | TRUE |
| Bacteroides_vulgatus | clade_378 | clade_408 | hetero | ++++ | FALSE | TRUE |
| Bacteroides_vulgatus | clade_378 | clade_172 | hetero | ++ | FALSE | TRUE |
| Bacteroides_vulgatus | clade_378 | clade_262 | hetero | ++++ | FALSE | TRUE |
| Bacteroides_vulgatus | clade_378 | clade_408 | hetero | ++ | FALSE | TRUE |
| Bacteroides_vulgatus | clade_378 | clade_444 | hetero | ++ | FALSE | TRUE |
| Bacteroides_vulgatus | clade_378 | clade_478 | hetero | + | FALSE | TRUE |
| Bacteroides_vulgatus | clade_378 | clade_466 | hetero | ++ | FALSE | TRUE |
| Bacteroides_vulgatus | clade_378 | clade_260 | hetero | ++++ | FALSE | TRUE |
| Bacteroides_vulgatus | clade_378 | clade_309 | hetero | ++++ | FALSE | TRUE |
| Bacteroides_vulgatus | clade_378 | clade_500 | hetero | ++++ | FALSE | TRUE |
| Bacteroides_vulgatus | clade_378 | clade_309 | hetero | ++++ | FALSE | TRUE |
| Bacteroides_sp_1_1_6 | clade_65 | clade_65 | homo | ++++ | TRUE | TRUE |
| Bacteroides_sp_1_1_6 | clade_65 | clade_38 | hetero | +++ | FALSE | FALSE |
| Bacteroides_sp_1_1_6 | clade_65 | clade_497 | hetero | ++++ | TRUE | TRUE |
| Bacteroides_sp_1_1_6 | clade_65 | clade_481 | hetero | ++++ | FALSE | TRUE |
| Bacteroides_sp_1_1_6 | clade_65 | clade_98 | hetero | ++++ | FALSE | FALSE |
| Bacteroides_sp_1_1_6 | clade_65 | clade_360 | hetero | ++++ | FALSE | TRUE |
| Bacteroides_sp_1_1_6 | clade_65 | clade_309 | hetero | ++++ | TRUE | TRUE |
| Bacteroides_sp_1_1_6 | clade_65 | clade_522 | hetero | ++++ | FALSE | TRUE |
| Bacteroides_sp_1_1_6 | clade_65 | clade_262 | hetero | ++++ | TRUE | TRUE |
| Bacteroides_sp_1_1_6 | clade_65 | clade_351 | hetero | ++++ | FALSE | TRUE |
| Bacteroides_sp_1_1_6 | clade_65 | clade_478 | hetero | ++++ | FALSE | TRUE |
| Bacteroides_sp_1_1_6 | clade_65 | clade_466 | hetero | ++++ | TRUE | TRUE |
| Bacteroides_sp_1_1_6 | clade_65 | clade_360 | hetero | ++++ | FALSE | TRUE |
| Bacteroides_sp_1_1_6 | clade_65 | clade_444 | hetero | ++++ | FALSE | TRUE |
| Bacteroides_sp_1_1_6 | clade_65 | clade_393 | hetero | +++ | FALSE | TRUE |
| Bacteroides_sp_1_1_6 | clade_65 | clade_479 | hetero | ++++ | FALSE | FALSE |
| Bacteroides_sp_1_1_6 | clade_65 | clade_110 | hetero | +++ | FALSE | TRUE |
| Bacteroides_sp_1_1_6 | clade_65 | clade_38 | hetero | +++ | FALSE | FALSE |
| Bacteroides_sp_1_1_6 | clade_65 | clade_286 | hetero | ++++ | FALSE | FALSE |
| Bacteroides_sp_1_1_6 | clade_65 | clade_378 | hetero | ++++ | TRUE | TRUE |
| Bacteroides_sp_1_1_6 | clade_65 | clade_553 | hetero | +++ | FALSE | FALSE |
| Bacteroides_sp_1_1_6 | clade_65 | clade_92 | hetero | ++++ | FALSE | FALSE |

TABLE 4a-continued

| | | | | | |
|---|---|---|---|---|---|
| Bacteroides_sp_1_1_6 | clade_65 | clade_309 | hetero | ++ | FALSE | FALSE |
| Bacteroides_sp_1_1_6 | clade_65 | clade_170 | hetero | +++ | FALSE | FALSE |
| Bacteroides_sp_1_1_6 | clade_65 | clade_85 | hetero | +++ | FALSE | FALSE |
| Bacteroides_sp_1_1_6 | clade_65 | clade_262 | hetero | ++++ | TRUE | FALSE |
| Bacteroides_sp_1_1_6 | clade_65 | clade_408 | hetero | ++++ | FALSE | FALSE |
| Bacteroides_sp_1_1_6 | clade_65 | clade_172 | hetero | ++++ | TRUE | TRUE |
| Bacteroides_sp_1_1_6 | clade_65 | clade_172 | hetero | ++ | TRUE | TRUE |
| Bacteroides_sp_1_1_6 | clade_65 | clade_262 | hetero | ++++ | TRUE | FALSE |
| Bacteroides_sp_1_1_6 | clade_65 | clade_408 | hetero | ++++ | FALSE | TRUE |
| Bacteroides_sp_1_1_6 | clade_65 | clade_444 | hetero | +++ | FALSE | TRUE |
| Bacteroides_sp_1_1_6 | clade_65 | clade_478 | hetero | +++ | FALSE | FALSE |
| Bacteroides_sp_1_1_6 | clade_65 | clade_466 | hetero | + | FALSE | FALSE |
| Bacteroides_sp_1_1_6 | clade_65 | clade_260 | hetero | ++ | FALSE | FALSE |
| Bacteroides_sp_1_1_6 | clade_65 | clade_309 | hetero | ++ | FALSE | FALSE |
| Bacteroides_sp_1_1_6 | clade_65 | clade_500 | hetero | +++ | FALSE | TRUE |
| Bacteroides_sp_1_1_6 | clade_65 | clade_309 | hetero | ++++ | FALSE | TRUE |
| Bacteroides_sp_1_1_6 | clade_65 | clade_38 | homo | | FALSE | FALSE |
| Bacteroides_sp_3_1_23 | clade_38 | clade_497 | hetero | ++++ | TRUE | TRUE |
| Bacteroides_sp_3_1_23 | clade_38 | clade_481 | hetero | | FALSE | TRUE |
| Bacteroides_sp_3_1_23 | clade_38 | clade_98 | hetero | ++ | FALSE | TRUE |
| Bacteroides_sp_3_1_23 | clade_38 | clade_360 | hetero | ++++ | FALSE | TRUE |
| Bacteroides_sp_3_1_23 | clade_38 | clade_309 | hetero | ++++ | FALSE | TRUE |
| Bacteroides_sp_3_1_23 | clade_38 | clade_522 | hetero | +++ | FALSE | TRUE |
| Bacteroides_sp_3_1_23 | clade_38 | clade_262 | hetero | + | FALSE | TRUE |
| Bacteroides_sp_3_1_23 | clade_38 | clade_351 | hetero | ++ | FALSE | TRUE |
| Bacteroides_sp_3_1_23 | clade_38 | clade_478 | hetero | | FALSE | TRUE |
| Bacteroides_sp_3_1_23 | clade_38 | clade_466 | hetero | +++ | FALSE | TRUE |
| Bacteroides_sp_3_1_23 | clade_38 | clade_360 | hetero | ++ | FALSE | TRUE |
| Bacteroides_sp_3_1_23 | clade_38 | clade_444 | hetero | ++++ | FALSE | FALSE |
| Bacteroides_sp_3_1_23 | clade_38 | clade_393 | hetero | ++ | FALSE | TRUE |
| Bacteroides_sp_3_1_23 | clade_38 | clade_479 | hetero | ++++ | FALSE | TRUE |
| Bacteroides_sp_3_1_23 | clade_38 | clade_110 | hetero | ++ | TRUE | FALSE |
| Bacteroides_sp_3_1_23 | clade_38 | clade_38 | hetero | + | TRUE | FALSE |
| Bacteroides_sp_3_1_23 | clade_38 | clade_286 | hetero | +++ | FALSE | TRUE |
| Bacteroides_sp_3_1_23 | clade_38 | clade_378 | hetero | ++++ | FALSE | FALSE |
| Bacteroides_sp_3_1_23 | clade_38 | clade_553 | hetero | ++++ | TRUE | FALSE |
| Bacteroides_sp_3_1_23 | clade_38 | clade_92 | hetero | ++ | FALSE | TRUE |
| Bacteroides_sp_3_1_23 | clade_38 | clade_309 | hetero | +++ | FALSE | TRUE |
| Bacteroides_sp_3_1_23 | clade_38 | clade_170 | hetero | ++++ | FALSE | FALSE |
| Bacteroides_sp_3_1_23 | clade_38 | clade_85 | hetero | + | FALSE | FALSE |
| Bacteroides_sp_3_1_23 | clade_38 | clade_262 | hetero | +++ | FALSE | FALSE |
| Bacteroides_sp_3_1_23 | clade_38 | clade_408 | hetero | ++++ | TRUE | TRUE |
| Bacteroides_sp_3_1_23 | clade_38 | clade_172 | hetero | +++ | TRUE | TRUE |
| Bacteroides_sp_3_1_23 | clade_38 | clade_262 | hetero | ++++ | FALSE | FALSE |
| Bacteroides_sp_3_1_23 | clade_38 | clade_408 | hetero | ++ | FALSE | FALSE |
| Bacteroides_sp_3_1_23 | clade_38 | clade_444 | hetero | | FALSE | TRUE |
| Bacteroides_sp_3_1_23 | clade_38 | clade_478 | hetero | | FALSE | TRUE |
| Bacteroides_sp_3_1_23 | clade_38 | clade_466 | hetero | | FALSE | TRUE |
| Bacteroides_sp_3_1_23 | clade_38 | clade_260 | hetero | | FALSE | TRUE |
| Bacteroides_sp_3_1_23 | clade_38 | clade_500 | hetero | | FALSE | TRUE |
| Bacteroides_sp_3_1_23 | clade_38 | clade_309 | hetero | + | FALSE | FALSE |

TABLE 4a-continued

| | | | | | |
|---|---|---|---|---|---|
| Enterococcus_faecalis | clade_497 | clade_497 | homo | ++++ | TRUE |
| Enterococcus_faecalis | clade_497 | clade_481 | hetero | ++++ | TRUE | TRUE |
| Enterococcus_faecalis | clade_497 | clade_98 | hetero | ++++ | TRUE | TRUE |
| Enterococcus_faecalis | clade_497 | clade_360 | hetero | ++++ | TRUE | TRUE |
| Enterococcus_faecalis | clade_497 | clade_309 | hetero | ++++ | TRUE | TRUE |
| Enterococcus_faecalis | clade_497 | clade_522 | hetero | ++++ | TRUE | TRUE |
| Enterococcus_faecalis | clade_497 | clade_262 | hetero | ++++ | TRUE | TRUE |
| Enterococcus_faecalis | clade_497 | clade_351 | hetero | ++++ | TRUE | TRUE |
| Enterococcus_faecalis | clade_497 | clade_478 | hetero | ++++ | TRUE | TRUE |
| Enterococcus_faecalis | clade_497 | clade_466 | hetero | ++++ | TRUE | TRUE |
| Enterococcus_faecalis | clade_497 | clade_360 | hetero | ++++ | TRUE | TRUE |
| Enterococcus_faecalis | clade_497 | clade_444 | hetero | ++++ | TRUE | TRUE |
| Enterococcus_faecalis | clade_497 | clade_393 | hetero | ++++ | TRUE | TRUE |
| Enterococcus_faecalis | clade_497 | clade_479 | hetero | ++++ | TRUE | TRUE |
| Enterococcus_faecalis | clade_497 | clade_110 | hetero | ++++ | TRUE | TRUE |
| Enterococcus_faecalis | clade_497 | clade_38 | hetero | ++++ | TRUE | TRUE |
| Enterococcus_faecalis | clade_497 | clade_286 | hetero | ++++ | TRUE | TRUE |
| Enterococcus_faecalis | clade_497 | clade_378 | hetero | ++++ | TRUE | TRUE |
| Enterococcus_faecalis | clade_497 | clade_553 | hetero | ++++ | TRUE | TRUE |
| Enterococcus_faecalis | clade_497 | clade_92 | hetero | +++ | FALSE | FALSE |
| Enterococcus_faecalis | clade_497 | clade_309 | hetero | ++++ | TRUE | TRUE |
| Enterococcus_faecalis | clade_497 | clade_170 | hetero | ++++ | TRUE | TRUE |
| Enterococcus_faecalis | clade_497 | clade_85 | hetero | ++++ | TRUE | TRUE |
| Enterococcus_faecalis | clade_497 | clade_262 | hetero | ++++ | TRUE | TRUE |
| Enterococcus_faecalis | clade_497 | clade_408 | hetero | ++++ | TRUE | TRUE |
| Enterococcus_faecalis | clade_497 | clade_172 | hetero | ++++ | TRUE | TRUE |
| Enterococcus_faecalis | clade_497 | clade_262 | hetero | ++++ | TRUE | TRUE |
| Enterococcus_faecalis | clade_497 | clade_408 | hetero | ++++ | TRUE | TRUE |
| Enterococcus_faecalis | clade_497 | clade_444 | hetero | ++++ | TRUE | TRUE |
| Enterococcus_faecalis | clade_497 | clade_478 | hetero | ++++ | TRUE | TRUE |
| Enterococcus_faecalis | clade_497 | clade_466 | hetero | ++++ | TRUE | TRUE |
| Enterococcus_faecalis | clade_497 | clade_260 | hetero | ++++ | TRUE | TRUE |
| Enterococcus_faecalis | clade_497 | clade_309 | hetero | ++++ | TRUE | TRUE |
| Enterococcus_faecalis | clade_497 | clade_500 | hetero | ++++ | TRUE | TRUE |
| Enterococcus_faecalis | clade_497 | clade_309 | hetero | ++++ | TRUE | TRUE |
| Coprobacillus_sp_D7 | clade_481 | clade_481 | homo | | FALSE | TRUE |
| Coprobacillus_sp_D7 | clade_481 | clade_98 | hetero | ++++ | FALSE | TRUE |
| Coprobacillus_sp_D7 | clade_481 | clade_360 | hetero | | FALSE | TRUE |
| Coprobacillus_sp_D7 | clade_481 | clade_309 | hetero | ++++ | TRUE | TRUE |
| Coprobacillus_sp_D7 | clade_481 | clade_522 | hetero | | FALSE | FALSE |
| Coprobacillus_sp_D7 | clade_481 | clade_262 | hetero | | FALSE | FALSE |
| Coprobacillus_sp_D7 | clade_481 | clade_351 | hetero | | FALSE | FALSE |
| Coprobacillus_sp_D7 | clade_481 | clade_478 | hetero | − | FALSE | FALSE |
| Coprobacillus_sp_D7 | clade_481 | clade_466 | hetero | | FALSE | FALSE |
| Coprobacillus_sp_D7 | clade_481 | clade_360 | hetero | | FALSE | TRUE |
| Coprobacillus_sp_D7 | clade_481 | clade_444 | hetero | | FALSE | TRUE |
| Coprobacillus_sp_D7 | clade_481 | clade_393 | hetero | − | FALSE | FALSE |
| Coprobacillus_sp_D7 | clade_481 | clade_479 | hetero | | FALSE | TRUE |
| Coprobacillus_sp_D7 | clade_481 | clade_110 | hetero | | FALSE | TRUE |
| Coprobacillus_sp_D7 | clade_481 | clade_38 | hetero | − | FALSE | FALSE |
| Coprobacillus_sp_D7 | clade_481 | clade_286 | hetero | | FALSE | FALSE |
| Coprobacillus_sp_D7 | clade_481 | clade_378 | hetero | | FALSE | FALSE |

TABLE 4a-continued

| Species | Clade A | Clade B | Type | Score | Col1 | Col2 |
|---|---|---|---|---|---|---|
| Coprobacillus_sp_D7 | clade_481 | clade_553 | hetero | | FALSE | TRUE |
| Coprobacillus_sp_D7 | clade_481 | clade_92 | hetero | | FALSE | TRUE |
| Coprobacillus_sp_D7 | clade_481 | clade_309 | hetero | ++ | FALSE | FALSE |
| Coprobacillus_sp_D7 | clade_481 | clade_170 | hetero | + | FALSE | FALSE |
| Coprobacillus_sp_D7 | clade_481 | clade_85 | hetero | ++ | FALSE | FALSE |
| Coprobacillus_sp_D7 | clade_481 | clade_262 | hetero | | FALSE | TRUE |
| Coprobacillus_sp_D7 | clade_481 | clade_408 | hetero | +++ | FALSE | TRUE |
| Coprobacillus_sp_D7 | clade_481 | clade_172 | hetero | +++ | FALSE | TRUE |
| Coprobacillus_sp_D7 | clade_481 | clade_262 | hetero | ++++ | TRUE | TRUE |
| Coprobacillus_sp_D7 | clade_481 | clade_408 | hetero | ++ | FALSE | TRUE |
| Coprobacillus_sp_D7 | clade_481 | clade_444 | hetero | | FALSE | TRUE |
| Coprobacillus_sp_D7 | clade_481 | clade_478 | hetero | ++ | FALSE | TRUE |
| Coprobacillus_sp_D7 | clade_481 | clade_466 | hetero | +++ | FALSE | TRUE |
| Coprobacillus_sp_D7 | clade_481 | clade_260 | hetero | ++++ | FALSE | TRUE |
| Coprobacillus_sp_D7 | clade_481 | clade_309 | hetero | +++ | FALSE | TRUE |
| Coprobacillus_sp_D7 | clade_481 | clade_500 | hetero | ++++ | TRUE | TRUE |
| Coprobacillus_sp_D7 | clade_481 | clade_309 | hetero | +++++ | FALSE | TRUE |
| Streptococcus_thermophilus | clade_98 | clade_98 | homo | | FALSE | TRUE |
| Streptococcus_thermophilus | clade_98 | clade_360 | hetero | | FALSE | TRUE |
| Streptococcus_thermophilus | clade_98 | clade_309 | hetero | ++++ | TRUE | FALSE |
| Streptococcus_thermophilus | clade_98 | clade_522 | hetero | | FALSE | FALSE |
| Streptococcus_thermophilus | clade_98 | clade_262 | hetero | + | FALSE | TRUE |
| Streptococcus_thermophilus | clade_98 | clade_351 | hetero | | FALSE | TRUE |
| Streptococcus_thermophilus | clade_98 | clade_478 | hetero | | FALSE | FALSE |
| Streptococcus_thermophilus | clade_98 | clade_466 | hetero | | FALSE | FALSE |
| Streptococcus_thermophilus | clade_98 | clade_360 | hetero | | FALSE | TRUE |
| Streptococcus_thermophilus | clade_98 | clade_444 | hetero | | FALSE | FALSE |
| Streptococcus_thermophilus | clade_98 | clade_393 | hetero | + + | FALSE | FALSE |
| Streptococcus_thermophilus | clade_98 | clade_479 | hetero | − | FALSE | FALSE |
| Streptococcus_thermophilus | clade_98 | clade_110 | hetero | ++ | FALSE | TRUE |
| Streptococcus_thermophilus | clade_98 | clade_38 | hetero | ++ | FALSE | TRUE |
| Streptococcus_thermophilus | clade_98 | clade_286 | hetero | + | FALSE | FALSE |
| Streptococcus_thermophilus | clade_98 | clade_378 | hetero | ++++ | TRUE | FALSE |
| Streptococcus_thermophilus | clade_98 | clade_553 | hetero | +++ | FALSE | TRUE |
| Streptococcus_thermophilus | clade_98 | clade_92 | hetero | + | FALSE | FALSE |
| Streptococcus_thermophilus | clade_98 | clade_309 | hetero | | FALSE | FALSE |
| Streptococcus_thermophilus | clade_98 | clade_170 | hetero | | FALSE | TRUE |
| Streptococcus_thermophilus | clade_98 | clade_85 | hetero | | FALSE | FALSE |
| Streptococcus_thermophilus | clade_98 | clade_262 | hetero | | FALSE | TRUE |
| Streptococcus_thermophilus | clade_98 | clade_408 | hetero | | FALSE | TRUE |
| Streptococcus_thermophilus | clade_98 | clade_172 | hetero | | FALSE | FALSE |
| Streptococcus_thermophilus | clade_98 | clade_262 | hetero | | FALSE | TRUE |
| Streptococcus_thermophilus | clade_98 | clade_408 | hetero | | FALSE | FALSE |
| Streptococcus_thermophilus | clade_98 | clade_444 | hetero | | FALSE | FALSE |
| Streptococcus_thermophilus | clade_98 | clade_478 | hetero | | FALSE | TRUE |
| Streptococcus_thermophilus | clade_98 | clade_466 | hetero | | FALSE | FALSE |
| Streptococcus_thermophilus | clade_98 | clade_260 | hetero | | FALSE | TRUE |
| Streptococcus_thermophilus | clade_98 | clade_309 | hetero | | FALSE | FALSE |
| Streptococcus_thermophilus | clade_98 | clade_500 | hetero | | FALSE | FALSE |
| Dorea_formicigenerans | clade_360 | clade_360 | homo | | FALSE | FALSE |

TABLE 4a-continued

| Species | Clade A | Clade B | Type | Signal | Col6 | Col7 |
|---|---|---|---|---|---|---|
| Dorea_formicigenerans | clade_360 | clade_309 | hetero | ++++ | FALSE | TRUE |
| Dorea_formicigenerans | clade_360 | clade_522 | hetero | − | FALSE | FALSE |
| Dorea_formicigenerans | clade_360 | clade_262 | hetero | | FALSE | TRUE |
| Dorea_formicigenerans | clade_360 | clade_351 | hetero | | FALSE | FALSE |
| Dorea_formicigenerans | clade_360 | clade_478 | hetero | | FALSE | TRUE |
| Dorea_formicigenerans | clade_360 | clade_466 | hetero | | FALSE | TRUE |
| Dorea_formicigenerans | clade_360 | clade_360 | hetero | + | FALSE | TRUE |
| Dorea_formicigenerans | clade_360 | clade_444 | hetero | | FALSE | TRUE |
| Dorea_formicigenerans | clade_360 | clade_393 | hetero | | FALSE | TRUE |
| Dorea_formicigenerans | clade_360 | clade_479 | hetero | − | FALSE | FALSE |
| Dorea_formicigenerans | clade_360 | clade_110 | hetero | | FALSE | TRUE |
| Dorea_formicigenerans | clade_360 | clade_38 | hetero | | FALSE | FALSE |
| Dorea_formicigenerans | clade_360 | clade_286 | hetero | | FALSE | TRUE |
| Dorea_formicigenerans | clade_360 | clade_378 | hetero | | FALSE | TRUE |
| Dorea_formicigenerans | clade_360 | clade_553 | hetero | + | FALSE | TRUE |
| Dorea_formicigenerans | clade_360 | clade_92 | hetero | +++ | FALSE | TRUE |
| Dorea_formicigenerans | clade_360 | clade_309 | hetero | +++ | FALSE | TRUE |
| Dorea_formicigenerans | clade_360 | clade_170 | hetero | ++ | FALSE | TRUE |
| Dorea_formicigenerans | clade_360 | clade_85 | hetero | | FALSE | FALSE |
| Dorea_formicigenerans | clade_360 | clade_262 | hetero | +++ | FALSE | FALSE |
| Dorea_formicigenerans | clade_360 | clade_408 | hetero | +++ | FALSE | TRUE |
| Dorea_formicigenerans | clade_360 | clade_172 | hetero | ++ | FALSE | TRUE |
| Dorea_formicigenerans | clade_360 | clade_262 | hetero | ++++ | TRUE | TRUE |
| Dorea_formicigenerans | clade_360 | clade_408 | hetero | | FALSE | FALSE |
| Dorea_formicigenerans | clade_360 | clade_444 | hetero | | FALSE | FALSE |
| Dorea_formicigenerans | clade_360 | clade_478 | hetero | | FALSE | FALSE |
| Dorea_formicigenerans | clade_360 | clade_466 | hetero | | FALSE | FALSE |
| Dorea_formicigenerans | clade_360 | clade_260 | hetero | − | FALSE | FALSE |
| Dorea_formicigenerans | clade_360 | clade_309 | hetero | −− | FALSE | FALSE |
| Dorea_formicigenerans | clade_360 | clade_500 | hetero | | FALSE | FALSE |
| Dorea_formicigenerans | clade_360 | clade_309 | hetero | − | FALSE | FALSE |
| Blautia_producta | clade_309 | clade_309 | homo | ++++ | TRUE | TRUE |
| Blautia_producta | clade_309 | clade_522 | hetero | ++++ | TRUE | TRUE |
| Blautia_producta | clade_309 | clade_262 | hetero | ++++ | TRUE | TRUE |
| Blautia_producta | clade_309 | clade_351 | hetero | ++++ | TRUE | TRUE |
| Blautia_producta | clade_309 | clade_478 | hetero | ++++ | TRUE | TRUE |
| Blautia_producta | clade_309 | clade_466 | hetero | ++++ | TRUE | TRUE |
| Blautia_producta | clade_309 | clade_360 | hetero | ++++ | TRUE | TRUE |
| Blautia_producta | clade_309 | clade_444 | hetero | ++++ | FALSE | TRUE |
| Blautia_producta | clade_309 | clade_393 | hetero | ++++ | FALSE | TRUE |
| Blautia_producta | clade_309 | clade_479 | hetero | ++++ | FALSE | TRUE |
| Blautia_producta | clade_309 | clade_110 | hetero | ++++ | FALSE | FALSE |
| Blautia_producta | clade_309 | clade_38 | hetero | ++++ | FALSE | TRUE |
| Blautia_producta | clade_309 | clade_286 | hetero | ++++ | TRUE | TRUE |
| Blautia_producta | clade_309 | clade_378 | hetero | ++++ | TRUE | TRUE |
| Blautia_producta | clade_309 | clade_553 | hetero | +++++ | TRUE | TRUE |
| Blautia_producta | clade_309 | clade_92 | hetero | ++++ | TRUE | TRUE |
| Blautia_producta | clade_309 | clade_309 | hetero | ++++ | TRUE | FALSE |
| Blautia_producta | clade_309 | clade_170 | hetero | ++++ | TRUE | TRUE |
| Blautia_producta | clade_309 | clade_85 | hetero | ++++ | TRUE | FALSE |
| Blautia_producta | clade_309 | clade_262 | hetero | ++++ | TRUE | FALSE |
| Blautia_producta | clade_309 | clade_408 | hetero | ++++ | TRUE | FALSE |

TABLE 4a-continued

| Species | | | | | |
|---|---|---|---|---|---|
| Blautia_producta | clade_309 | clade_172 | | hetero | | FALSE | FALSE |
| Blautia_producta | clade_309 | clade_172 | | hetero | TRUE | TRUE |
| Blautia_producta | clade_309 | clade_262 | ++++ | hetero | TRUE | TRUE |
| Blautia_producta | clade_309 | clade_408 | ++++ | hetero | TRUE | TRUE |
| Blautia_producta | clade_309 | clade_444 | ++++ | hetero | TRUE | TRUE |
| Blautia_producta | clade_309 | clade_478 | ++++ | hetero | TRUE | TRUE |
| Blautia_producta | clade_309 | clade_466 | ++++ | hetero | TRUE | TRUE |
| Blautia_producta | clade_309 | clade_260 | ++++ | hetero | TRUE | TRUE |
| Blautia_producta | clade_309 | clade_500 | ++++ | hetero | TRUE | TRUE |
| Blautia_producta | clade_309 | clade_309 | ++++ | hetero | TRUE | TRUE |
| Eubacterium_eligens | clade_522 | clade_522 | | homo | FALSE | TRUE |
| Eubacterium_eligens | clade_522 | clade_262 | | hetero | FALSE | FALSE |
| Eubacterium_eligens | clade_522 | clade_351 | | hetero | FALSE | FALSE |
| Eubacterium_eligens | clade_522 | clade_478 | | hetero | FALSE | FALSE |
| Eubacterium_eligens | clade_522 | clade_466 | | hetero | FALSE | FALSE |
| Eubacterium_eligens | clade_522 | clade_360 | + | hetero | FALSE | TRUE |
| Eubacterium_eligens | clade_522 | clade_444 | | hetero | FALSE | TRUE |
| Eubacterium_eligens | clade_522 | clade_393 | | hetero | FALSE | FALSE |
| Eubacterium_eligens | clade_522 | clade_479 | − | hetero | FALSE | FALSE |
| Eubacterium_eligens | clade_522 | clade_110 | − | hetero | FALSE | FALSE |
| Eubacterium_eligens | clade_522 | clade_38 | | hetero | FALSE | FALSE |
| Eubacterium_eligens | clade_522 | clade_286 | | hetero | FALSE | FALSE |
| Eubacterium_eligens | clade_522 | clade_378 | | hetero | FALSE | FALSE |
| Eubacterium_eligens | clade_522 | clade_553 | ++ | hetero | FALSE | TRUE |
| Eubacterium_eligens | clade_522 | clade_92 | ++++ | hetero | FALSE | TRUE |
| Eubacterium_eligens | clade_522 | clade_309 | | hetero | FALSE | FALSE |
| Eubacterium_eligens | clade_522 | clade_170 | + | hetero | FALSE | FALSE |
| Eubacterium_eligens | clade_522 | clade_85 | | hetero | FALSE | FALSE |
| Eubacterium_eligens | clade_522 | clade_262 | + | hetero | FALSE | FALSE |
| Eubacterium_eligens | clade_522 | clade_408 | + | hetero | FALSE | FALSE |
| Eubacterium_eligens | clade_522 | clade_172 | ++++ | hetero | FALSE | TRUE |
| Eubacterium_eligens | clade_522 | clade_172 | + | hetero | FALSE | TRUE |
| Eubacterium_eligens | clade_522 | clade_262 | | hetero | FALSE | TRUE |
| Eubacterium_eligens | clade_522 | clade_408 | | hetero | FALSE | TRUE |
| Eubacterium_eligens | clade_522 | clade_444 | | hetero | FALSE | FALSE |
| Eubacterium_eligens | clade_522 | clade_478 | | hetero | FALSE | FALSE |
| Eubacterium_eligens | clade_522 | clade_466 | | hetero | FALSE | FALSE |
| Eubacterium_eligens | clade_522 | clade_260 | | hetero | FALSE | FALSE |
| Eubacterium_eligens | clade_522 | clade_309 | | hetero | FALSE | FALSE |
| Eubacterium_eligens | clade_522 | clade_500 | | hetero | FALSE | FALSE |
| Eubacterium_eligens | clade_522 | clade_309 | | hetero | FALSE | FALSE |
| Clostridium_nexile | clade_262 | clade_262 | | homo | FALSE | FALSE |
| Clostridium_nexile | clade_262 | clade_351 | − | hetero | FALSE | TRUE |
| Clostridium_nexile | clade_262 | clade_478 | − | hetero | FALSE | FALSE |
| Clostridium_nexile | clade_262 | clade_466 | + | hetero | FALSE | FALSE |
| Clostridium_nexile | clade_262 | clade_360 | | hetero | FALSE | TRUE |
| Clostridium_nexile | clade_262 | clade_444 | +++ | hetero | FALSE | FALSE |
| Clostridium_nexile | clade_262 | clade_393 | | hetero | FALSE | FALSE |
| Clostridium_nexile | clade_262 | clade_479 | | hetero | FALSE | FALSE |
| Clostridium_nexile | clade_262 | clade_110 | | hetero | FALSE | FALSE |
| Clostridium_nexile | clade_262 | clade_38 | | hetero | FALSE | FALSE |
| Clostridium_nexile | clade_262 | clade_286 | + | hetero | FALSE | FALSE |

TABLE 4a-continued

| | | | | | |
|---|---|---|---|---|---|
| Clostridium_nexile | clade_262 | clade_378 | hetero | | FALSE | FALSE |
| Clostridium_nexile | clade_262 | clade_553 | hetero | | FALSE | FALSE |
| Clostridium_nexile | clade_262 | clade_92 | hetero | +++ | FALSE | FALSE |
| Clostridium_nexile | clade_262 | clade_309 | hetero | | FALSE | FALSE |
| Clostridium_nexile | clade_262 | clade_170 | hetero | | FALSE | FALSE |
| Clostridium_nexile | clade_262 | clade_85 | hetero | | FALSE | FALSE |
| Clostridium_nexile | clade_262 | clade_262 | hetero | | FALSE | FALSE |
| Clostridium_nexile | clade_262 | clade_408 | hetero | ++++ | TRUE | TRUE |
| Clostridium_nexile | clade_262 | clade_172 | hetero | ++++ | TRUE | FALSE |
| Clostridium_nexile | clade_262 | clade_262 | hetero | + | FALSE | FALSE |
| Clostridium_nexile | clade_262 | clade_408 | hetero | − | FALSE | FALSE |
| Clostridium_nexile | clade_262 | clade_444 | hetero | − | FALSE | FALSE |
| Clostridium_nexile | clade_262 | clade_478 | hetero | −− | FALSE | FALSE |
| Clostridium_nexile | clade_262 | clade_466 | hetero | −− | FALSE | FALSE |
| Clostridium_nexile | clade_262 | clade_260 | hetero | | FALSE | FALSE |
| Clostridium_nexile | clade_262 | clade_309 | hetero | | FALSE | FALSE |
| Clostridium_nexile | clade_262 | clade_500 | hetero | | FALSE | FALSE |
| Clostridium_nexile | clade_262 | clade_309 | hetero | | FALSE | FALSE |
| Clostridium_sp_HGF2 | clade_351 | clade_351 | homo | ++ | FALSE | FALSE |
| Clostridium_sp_HGF2 | clade_351 | clade_478 | hetero | + | FALSE | FALSE |
| Clostridium_sp_HGF2 | clade_351 | clade_466 | hetero | − | FALSE | FALSE |
| Clostridium_sp_HGF2 | clade_351 | clade_360 | hetero | −− | FALSE | FALSE |
| Clostridium_sp_HGF2 | clade_351 | clade_444 | hetero | − | FALSE | FALSE |
| Clostridium_sp_HGF2 | clade_351 | clade_393 | hetero | | FALSE | FALSE |
| Clostridium_sp_HGF2 | clade_351 | clade_479 | hetero | | FALSE | FALSE |
| Clostridium_sp_HGF2 | clade_351 | clade_110 | hetero | | FALSE | FALSE |
| Clostridium_sp_HGF2 | clade_351 | clade_38 | hetero | | FALSE | FALSE |
| Clostridium_sp_HGF2 | clade_351 | clade_286 | hetero | ++ | FALSE | FALSE |
| Clostridium_sp_HGF2 | clade_351 | clade_378 | hetero | ++ | FALSE | TRUE |
| Clostridium_sp_HGF2 | clade_351 | clade_553 | hetero | +++ | TRUE | TRUE |
| Clostridium_sp_HGF2 | clade_351 | clade_92 | hetero | +++ | FALSE | FALSE |
| Clostridium_sp_HGF2 | clade_351 | clade_309 | hetero | − | FALSE | FALSE |
| Clostridium_sp_HGF2 | clade_351 | clade_170 | hetero | | FALSE | FALSE |
| Clostridium_sp_HGF2 | clade_351 | clade_85 | hetero | | FALSE | FALSE |
| Clostridium_sp_HGF2 | clade_351 | clade_262 | hetero | | FALSE | FALSE |
| Clostridium_sp_HGF2 | clade_351 | clade_408 | hetero | ++ | FALSE | FALSE |
| Clostridium_sp_HGF2 | clade_351 | clade_172 | hetero | ++++ | FALSE | FALSE |
| Clostridium_sp_HGF2 | clade_351 | clade_262 | hetero | | FALSE | FALSE |
| Clostridium_sp_HGF2 | clade_351 | clade_408 | hetero | | FALSE | FALSE |
| Clostridium_sp_HGF2 | clade_351 | clade_444 | hetero | − | FALSE | FALSE |
| Clostridium_sp_HGF2 | clade_351 | clade_478 | hetero | −− | FALSE | FALSE |
| Clostridium_sp_HGF2 | clade_351 | clade_466 | hetero | | FALSE | FALSE |
| Clostridium_sp_HGF2 | clade_351 | clade_260 | hetero | | FALSE | FALSE |
| Clostridium_sp_HGF2 | clade_351 | clade_309 | hetero | | FALSE | FALSE |
| Clostridium_sp_HGF2 | clade_351 | clade_500 | hetero | | FALSE | FALSE |
| Clostridium_sp_HGF2 | clade_351 | clade_309 | hetero | | FALSE | FALSE |
| Faecalibacterium_prausnitzii | clade_478 | clade_478 | homo | | FALSE | FALSE |
| Faecalibacterium_prausnitzii | clade_478 | clade_466 | hetero | − | FALSE | FALSE |
| Faecalibacterium_prausnitzii | clade_478 | clade_360 | hetero | | FALSE | FALSE |
| Faecalibacterium_prausnitzii | clade_478 | clade_444 | hetero | | FALSE | FALSE |
| Faecalibacterium_prausnitzii | clade_478 | clade_393 | hetero | | FALSE | FALSE |

TABLE 4a-continued

| | | | | | |
|---|---|---|---|---|---|
| Faecalibacterium_prausnitzii | clade_478 | clade_479 | hetero | − | FALSE | FALSE |
| Faecalibacterium_prausnitzii | clade_478 | clade_110 | hetero | | FALSE | FALSE |
| Faecalibacterium_prausnitzii | clade_478 | clade_38 | hetero | | FALSE | FALSE |
| Faecalibacterium_prausnitzii | clade_478 | clade_286 | hetero | | FALSE | FALSE |
| Faecalibacterium_prausnitzii | clade_478 | clade_378 | hetero | | FALSE | FALSE |
| Faecalibacterium_prausnitzii | clade_478 | clade_553 | hetero | | FALSE | TRUE |
| Faecalibacterium_prausnitzii | clade_478 | clade_92 | hetero | ++ | FALSE | FALSE |
| Faecalibacterium_prausnitzii | clade_478 | clade_309 | hetero | +++ | FALSE | FALSE |
| Faecalibacterium_prausnitzii | clade_478 | clade_170 | hetero | | FALSE | FALSE |
| Faecalibacterium_prausnitzii | clade_478 | clade_85 | hetero | | FALSE | FALSE |
| Faecalibacterium_prausnitzii | clade_478 | clade_262 | hetero | | FALSE | FALSE |
| Faecalibacterium_prausnitzii | clade_478 | clade_408 | hetero | + | FALSE | FALSE |
| Faecalibacterium_prausnitzii | clade_478 | clade_172 | hetero | + | FALSE | FALSE |
| Faecalibacterium_prausnitzii | clade_478 | clade_262 | hetero | | FALSE | FALSE |
| Faecalibacterium_prausnitzii | clade_478 | clade_408 | hetero | | FALSE | FALSE |
| Faecalibacterium_prausnitzii | clade_478 | clade_444 | hetero | | FALSE | FALSE |
| Faecalibacterium_prausnitzii | clade_478 | clade_478 | hetero | − | FALSE | FALSE |
| Faecalibacterium_prausnitzii | clade_478 | clade_466 | hetero | | FALSE | FALSE |
| Faecalibacterium_prausnitzii | clade_478 | clade_260 | hetero | | FALSE | FALSE |
| Faecalibacterium_prausnitzii | clade_478 | clade_309 | hetero | | FALSE | FALSE |
| Faecalibacterium_prausnitzii | clade_478 | clade_500 | hetero | | FALSE | FALSE |
| Faecalibacterium_prausnitzii | clade_478 | clade_309 | hetero | | FALSE | FALSE |
| Odoribacter_splanchnicus | clade_466 | clade_466 | homo | | FALSE | TRUE |
| Odoribacter_splanchnicus | clade_466 | clade_360 | hetero | | FALSE | FALSE |
| Odoribacter_splanchnicus | clade_466 | clade_444 | hetero | | FALSE | FALSE |
| Odoribacter_splanchnicus | clade_466 | clade_393 | hetero | | FALSE | FALSE |
| Odoribacter_splanchnicus | clade_466 | clade_479 | hetero | | FALSE | FALSE |
| Odoribacter_splanchnicus | clade_466 | clade_110 | hetero | | FALSE | FALSE |
| Odoribacter_splanchnicus | clade_466 | clade_38 | hetero | | FALSE | FALSE |
| Odoribacter_splanchnicus | clade_466 | clade_286 | hetero | | FALSE | FALSE |
| Odoribacter_splanchnicus | clade_466 | clade_378 | hetero | | FALSE | FALSE |
| Odoribacter_splanchnicus | clade_466 | clade_553 | hetero | ++ | FALSE | TRUE |
| Odoribacter_splanchnicus | clade_466 | clade_92 | hetero | ++ | FALSE | TRUE |
| Odoribacter_splanchnicus | clade_466 | clade_309 | hetero | − | FALSE | FALSE |
| Odoribacter_splanchnicus | clade_466 | clade_170 | hetero | | FALSE | FALSE |
| Odoribacter_splanchnicus | clade_466 | clade_85 | hetero | | FALSE | FALSE |
| Odoribacter_splanchnicus | clade_466 | clade_262 | hetero | +++ | FALSE | FALSE |
| Odoribacter_splanchnicus | clade_466 | clade_408 | hetero | − | FALSE | FALSE |
| Odoribacter_splanchnicus | clade_466 | clade_444 | hetero | − | FALSE | FALSE |
| Odoribacter_splanchnicus | clade_466 | clade_478 | hetero | − | FALSE | FALSE |
| Odoribacter_splanchnicus | clade_466 | clade_466 | hetero | − | FALSE | FALSE |
| Odoribacter_splanchnicus | clade_466 | clade_260 | hetero | | FALSE | FALSE |
| Odoribacter_splanchnicus | clade_466 | clade_309 | hetero | − | FALSE | FALSE |
| Odoribacter_splanchnicus | clade_466 | clade_500 | hetero | | FALSE | FALSE |
| Odoribacter_splanchnicus | clade_466 | clade_309 | hetero | | FALSE | FALSE |
| Dorea_longicatena | clade_360 | clade_360 | homo | | FALSE | FALSE |
| Dorea_longicatena | clade_360 | clade_444 | hetero | | FALSE | FALSE |
| Dorea_longicatena | clade_360 | clade_393 | hetero | | FALSE | TRUE |

TABLE 4a-continued

| | | | | | |
|---|---|---|---|---|---|
| Dorea_longicatena | clade_360 | clade_479 | hetero | | FALSE | TRUE |
| Dorea_longicatena | clade_360 | clade_110 | hetero | | FALSE | TRUE |
| Dorea_longicatena | clade_360 | clade_38 | hetero | | FALSE | FALSE |
| Dorea_longicatena | clade_360 | clade_286 | hetero | | FALSE | FALSE |
| Dorea_longicatena | clade_360 | clade_378 | hetero | | FALSE | FALSE |
| Dorea_longicatena | clade_360 | clade_553 | hetero | | FALSE | TRUE |
| Dorea_longicatena | clade_360 | clade_92 | hetero | +++ | TRUE | TRUE |
| Dorea_longicatena | clade_360 | clade_309 | hetero | ++++ | FALSE | FALSE |
| Dorea_longicatena | clade_360 | clade_170 | hetero | | FALSE | FALSE |
| Dorea_longicatena | clade_360 | clade_85 | hetero | | FALSE | FALSE |
| Dorea_longicatena | clade_360 | clade_262 | hetero | | FALSE | FALSE |
| Dorea_longicatena | clade_360 | clade_408 | hetero | + | FALSE | TRUE |
| Dorea_longicatena | clade_360 | clade_172 | hetero | ++++ | FALSE | FALSE |
| Dorea_longicatena | clade_360 | clade_262 | hetero | +++ | FALSE | FALSE |
| Dorea_longicatena | clade_360 | clade_408 | hetero | ++++ | TRUE | TRUE |
| Dorea_longicatena | clade_360 | clade_444 | hetero | ++++ | FALSE | TRUE |
| Dorea_longicatena | clade_360 | clade_478 | hetero | ++ | FALSE | TRUE |
| Dorea_longicatena | clade_360 | clade_466 | hetero | ++++ | FALSE | TRUE |
| Dorea_longicatena | clade_360 | clade_260 | hetero | +++ | FALSE | TRUE |
| Dorea_longicatena | clade_360 | clade_309 | hetero | ++ | FALSE | TRUE |
| Dorea_longicatena | clade_360 | clade_500 | hetero | +++ | FALSE | TRUE |
| Dorea_longicatena | clade_360 | clade_309 | hetero | ++ | FALSE | TRUE |
| Roseburia_intestinalis | clade_444 | clade_444 | homo | | FALSE | FALSE |
| Roseburia_intestinalis | clade_444 | clade_393 | hetero | | FALSE | TRUE |
| Roseburia_intestinalis | clade_444 | clade_479 | hetero | | FALSE | FALSE |
| Roseburia_intestinalis | clade_444 | clade_110 | hetero | | FALSE | FALSE |
| Roseburia_intestinalis | clade_444 | clade_38 | hetero | | FALSE | FALSE |
| Roseburia_intestinalis | clade_444 | clade_286 | hetero | | FALSE | FALSE |
| Roseburia_intestinalis | clade_444 | clade_378 | hetero | | FALSE | TRUE |
| Roseburia_intestinalis | clade_444 | clade_553 | hetero | | FALSE | TRUE |
| Roseburia_intestinalis | clade_444 | clade_92 | hetero | + + | FALSE | FALSE |
| Roseburia_intestinalis | clade_444 | clade_309 | hetero | | FALSE | FALSE |
| Roseburia_intestinalis | clade_444 | clade_170 | hetero | | FALSE | FALSE |
| Roseburia_intestinalis | clade_444 | clade_85 | hetero | + + | FALSE | FALSE |
| Roseburia_intestinalis | clade_444 | clade_262 | hetero | ++ | FALSE | FALSE |
| Roseburia_intestinalis | clade_444 | clade_408 | hetero | ++ | FALSE | FALSE |
| Roseburia_intestinalis | clade_444 | clade_172 | hetero | | FALSE | FALSE |
| Roseburia_intestinalis | clade_444 | clade_262 | hetero | − − | FALSE | FALSE |
| Roseburia_intestinalis | clade_444 | clade_478 | hetero | | FALSE | FALSE |
| Roseburia_intestinalis | clade_444 | clade_466 | hetero | − | FALSE | FALSE |
| Roseburia_intestinalis | clade_444 | clade_260 | hetero | | FALSE | FALSE |
| Roseburia_intestinalis | clade_444 | clade_309 | hetero | − | FALSE | FALSE |
| Roseburia_intestinalis | clade_444 | clade_500 | homo | | FALSE | FALSE |
| Roseburia_intestinalis | clade_444 | clade_309 | hetero | | FALSE | FALSE |
| Coprococcus_catus | clade_393 | clade_393 | hetero | | FALSE | TRUE |
| Coprococcus_catus | clade_393 | clade_479 | hetero | | FALSE | TRUE |
| Coprococcus_catus | clade_393 | clade_110 | hetero | | FALSE | FALSE |
| Coprococcus_catus | clade_393 | clade_38 | hetero | | FALSE | FALSE |
| Coprococcus_catus | clade_393 | clade_286 | hetero | ++ | FALSE | TRUE |

TABLE 4a-continued

| Species | Clade A | Clade B | Score | Col5 | Col6 |
|---|---|---|---|---|---|
| Coprococcus_catus | clade_393 | clade_378 | + | FALSE | TRUE |
| Coprococcus_catus | clade_393 | clade_553 | +++ | FALSE | TRUE |
| Coprococcus_catus | clade_393 | clade_92 | ++++ | FALSE | TRUE |
| Coprococcus_catus | clade_393 | clade_309 | | FALSE | FALSE |
| Coprococcus_catus | clade_393 | clade_170 | +++ | FALSE | TRUE |
| Coprococcus_catus | clade_393 | clade_85 | | FALSE | FALSE |
| Coprococcus_catus | clade_393 | clade_262 | + | FALSE | FALSE |
| Coprococcus_catus | clade_393 | clade_408 | ++ | FALSE | FALSE |
| Coprococcus_catus | clade_393 | clade_172 | | FALSE | FALSE |
| Coprococcus_catus | clade_393 | clade_262 | – | FALSE | FALSE |
| Coprococcus_catus | clade_393 | clade_408 | | FALSE | FALSE |
| Coprococcus_catus | clade_393 | clade_444 | – – | FALSE | FALSE |
| Coprococcus_catus | clade_393 | clade_478 | – – | FALSE | FALSE |
| Coprococcus_catus | clade_393 | clade_466 | | FALSE | FALSE |
| Coprococcus_catus | clade_393 | clade_260 | – – | FALSE | FALSE |
| Coprococcus_catus | clade_393 | clade_309 | | FALSE | FALSE |
| Coprococcus_catus | clade_393 | clade_500 | – – | FALSE | FALSE |
| Coprococcus_catus | clade_393 | clade_309 | | FALSE | FALSE |
| Erysipelotrichaceae_bacterium_3_1_53 | clade_479 | clade_479 | | FALSE | TRUE |
| Erysipelotrichaceae_bacterium_3_1_53 | clade_479 | clade_110 | | FALSE | FALSE |
| Erysipelotrichaceae_bacterium_3_1_53 | clade_479 | clade_38 | | FALSE | TRUE |
| Erysipelotrichaceae_bacterium_3_1_53 | clade_479 | clade_286 | | FALSE | FALSE |
| Erysipelotrichaceae_bacterium_3_1_53 | clade_479 | clade_378 | +++ | FALSE | TRUE |
| Erysipelotrichaceae_bacterium_3_1_53 | clade_479 | clade_553 | ++++ | FALSE | TRUE |
| Erysipelotrichaceae_bacterium_3_1_53 | clade_479 | clade_92 | | FALSE | FALSE |
| Erysipelotrichaceae_bacterium_3_1_53 | clade_479 | clade_309 | + | FALSE | FALSE |
| Erysipelotrichaceae_bacterium_3_1_53 | clade_479 | clade_170 | | FALSE | FALSE |
| Erysipelotrichaceae_bacterium_3_1_53 | clade_479 | clade_85 | +++ | FALSE | FALSE |
| Erysipelotrichaceae_bacterium_3_1_53 | clade_479 | clade_262 | ++++ | FALSE | FALSE |
| Erysipelotrichaceae_bacterium_3_1_53 | clade_479 | clade_408 | | TRUE | TRUE |
| Erysipelotrichaceae_bacterium_3_1_53 | clade_479 | clade_172 | | FALSE | FALSE |
| Erysipelotrichaceae_bacterium_3_1_53 | clade_479 | clade_262 | – | FALSE | FALSE |
| Erysipelotrichaceae_bacterium_3_1_53 | clade_479 | clade_408 | – – | FALSE | FALSE |
| Erysipelotrichaceae_bacterium_3_1_53 | clade_479 | clade_444 | – – | FALSE | FALSE |
| Erysipelotrichaceae_bacterium_3_1_53 | clade_479 | clade_478 | – – | FALSE | FALSE |
| Erysipelotrichaceae_bacterium_3_1_53 | clade_479 | clade_466 | | FALSE | FALSE |
| Erysipelotrichaceae_bacterium_3_1_53 | clade_479 | clade_260 | | FALSE | FALSE |
| Erysipelotrichaceae_bacterium_3_1_53 | clade_479 | clade_309 | | FALSE | FALSE |
| Erysipelotrichaceae_bacterium_3_1_53 | clade_479 | clade_500 | | FALSE | FALSE |
| Erysipelotrichaceae_bacterium_3_1_53 | clade_479 | clade_309 | | FALSE | FALSE |
| Bacteroides_sp_D20 | clade_110 | clade_110 | | FALSE | FALSE |
| Bacteroides_sp_D20 | clade_110 | clade_38 | | FALSE | FALSE |
| Bacteroides_sp_D20 | clade_110 | clade_286 | ++++ | FALSE | TRUE |
| Bacteroides_sp_D20 | clade_110 | clade_378 | ++++ | TRUE | TRUE |
| Bacteroides_sp_D20 | clade_110 | clade_553 | | FALSE | TRUE |
| Bacteroides_sp_D20 | clade_110 | clade_92 | ++ | TRUE | FALSE |
| Bacteroides_sp_D20 | clade_110 | clade_309 | | FALSE | FALSE |
| Bacteroides_sp_D20 | clade_110 | clade_170 | + | FALSE | FALSE |
| Bacteroides_sp_D20 | clade_110 | clade_85 | | FALSE | FALSE |
| Bacteroides_sp_D20 | clade_110 | clade_262 | +++ | FALSE | TRUE |
| Bacteroides_sp_D20 | clade_110 | clade_408 | | FALSE | TRUE |

TABLE 4a-continued

| Species | Clade A | Clade B | Marker | Zygosity | Col1 | Col2 |
|---|---|---|---|---|---|---|
| Bacteroides_sp_D20 | clade_110 | clade_172 | − | hetero | FALSE | FALSE |
| Bacteroides_sp_D20 | clade_110 | clade_172 | ++++ | hetero | TRUE | TRUE |
| Bacteroides_sp_D20 | clade_110 | clade_262 | | hetero | FALSE | FALSE |
| Bacteroides_sp_D20 | clade_110 | clade_408 | | hetero | FALSE | FALSE |
| Bacteroides_sp_D20 | clade_110 | clade_444 | − | hetero | FALSE | FALSE |
| Bacteroides_sp_D20 | clade_110 | clade_478 | − | hetero | FALSE | FALSE |
| Bacteroides_sp_D20 | clade_110 | clade_466 | −− | hetero | FALSE | FALSE |
| Bacteroides_sp_D20 | clade_110 | clade_260 | −− | hetero | FALSE | FALSE |
| Bacteroides_sp_D20 | clade_110 | clade_309 | − | hetero | FALSE | FALSE |
| Bacteroides_sp_D20 | clade_110 | clade_500 | | hetero | FALSE | FALSE |
| Bacteroides_sp_D20 | clade_110 | clade_309 | | hetero | FALSE | FALSE |
| Bacteroides_ovatus | clade_38 | clade_38 | + | homo | FALSE | FALSE |
| Bacteroides_ovatus | clade_38 | clade_286 | | hetero | FALSE | FALSE |
| Bacteroides_ovatus | clade_38 | clade_378 | | hetero | FALSE | FALSE |
| Bacteroides_ovatus | clade_38 | clade_553 | ++++ | hetero | TRUE | TRUE |
| Bacteroides_ovatus | clade_38 | clade_92 | +++ | hetero | TRUE | TRUE |
| Bacteroides_ovatus | clade_38 | clade_309 | | hetero | FALSE | FALSE |
| Bacteroides_ovatus | clade_38 | clade_170 | | hetero | FALSE | FALSE |
| Bacteroides_ovatus | clade_38 | clade_85 | ++++ | hetero | TRUE | TRUE |
| Bacteroides_ovatus | clade_38 | clade_262 | +++ | hetero | FALSE | FALSE |
| Bacteroides_ovatus | clade_38 | clade_408 | ++++ | hetero | TRUE | TRUE |
| Bacteroides_ovatus | clade_38 | clade_172 | ++++ | hetero | TRUE | TRUE |
| Bacteroides_ovatus | clade_38 | clade_262 | | hetero | FALSE | FALSE |
| Bacteroides_ovatus | clade_38 | clade_408 | | hetero | FALSE | FALSE |
| Bacteroides_ovatus | clade_38 | clade_444 | | hetero | FALSE | FALSE |
| Bacteroides_ovatus | clade_38 | clade_478 | − | hetero | FALSE | FALSE |
| Bacteroides_ovatus | clade_38 | clade_466 | − | hetero | FALSE | FALSE |
| Bacteroides_ovatus | clade_38 | clade_260 | | hetero | FALSE | FALSE |
| Bacteroides_ovatus | clade_38 | clade_309 | + | hetero | FALSE | FALSE |
| Bacteroides_ovatus | clade_38 | clade_500 | | hetero | FALSE | FALSE |
| Bacteroides_ovatus | clade_38 | clade_309 | | hetero | FALSE | FALSE |
| Parabacteroides_merdae | clade_286 | clade_286 | | homo | FALSE | FALSE |
| Parabacteroides_merdae | clade_286 | clade_378 | | hetero | FALSE | FALSE |
| Parabacteroides_merdae | clade_286 | clade_553 | ++++ | hetero | FALSE | FALSE |
| Parabacteroides_merdae | clade_286 | clade_92 | ++++ | hetero | TRUE | TRUE |
| Parabacteroides_merdae | clade_286 | clade_309 | | hetero | FALSE | FALSE |
| Parabacteroides_merdae | clade_286 | clade_170 | | hetero | FALSE | FALSE |
| Parabacteroides_merdae | clade_286 | clade_85 | + | hetero | FALSE | FALSE |
| Parabacteroides_merdae | clade_286 | clade_262 | + | hetero | FALSE | FALSE |
| Parabacteroides_merdae | clade_286 | clade_408 | ++++ | hetero | FALSE | FALSE |
| Parabacteroides_merdae | clade_286 | clade_172 | ++++ | hetero | TRUE | TRUE |
| Parabacteroides_merdae | clade_286 | clade_262 | | hetero | FALSE | FALSE |
| Parabacteroides_merdae | clade_286 | clade_408 | | hetero | FALSE | FALSE |
| Parabacteroides_merdae | clade_286 | clade_444 | | hetero | FALSE | FALSE |
| Parabacteroides_merdae | clade_286 | clade_478 | | hetero | FALSE | FALSE |
| Parabacteroides_merdae | clade_286 | clade_466 | − | hetero | FALSE | FALSE |
| Parabacteroides_merdae | clade_286 | clade_260 | | hetero | FALSE | FALSE |
| Parabacteroides_merdae | clade_286 | clade_309 | | hetero | FALSE | FALSE |
| Parabacteroides_merdae | clade_286 | clade_500 | | hetero | FALSE | FALSE |
| Parabacteroides_merdae | clade_286 | clade_309 | ++ | hetero | FALSE | FALSE |
| Bacteroides_vulgatus | clade_378 | clade_378 | | homo | FALSE | FALSE |

TABLE 4a-continued

| | | | | | |
|---|---|---|---|---|---|
| Bacteroides_vulgatus | clade_378 | clade_553 | | hetero | | FALSE | TRUE |
| Bacteroides_vulgatus | clade_378 | clade_92 | +++ | hetero | TRUE | TRUE |
| Bacteroides_vulgatus | clade_378 | clade_309 | ++++ | hetero | FALSE | FALSE |
| Bacteroides_vulgatus | clade_378 | clade_170 | | hetero | FALSE | FALSE |
| Bacteroides_vulgatus | clade_378 | clade_85 | | hetero | FALSE | FALSE |
| Bacteroides_vulgatus | clade_378 | clade_262 | +++ | hetero | FALSE | FALSE |
| Bacteroides_vulgatus | clade_378 | clade_408 | ++++ | hetero | FALSE | TRUE |
| Bacteroides_vulgatus | clade_378 | clade_172 | ++++ | hetero | TRUE | TRUE |
| Bacteroides_vulgatus | clade_378 | clade_262 | ++++ | hetero | FALSE | TRUE |
| Bacteroides_vulgatus | clade_378 | clade_408 | | hetero | FALSE | FALSE |
| Bacteroides_vulgatus | clade_378 | clade_444 | | hetero | FALSE | FALSE |
| Bacteroides_vulgatus | clade_378 | clade_478 | -- | hetero | FALSE | FALSE |
| Bacteroides_vulgatus | clade_378 | clade_466 | | hetero | FALSE | FALSE |
| Bacteroides_vulgatus | clade_378 | clade_260 | - | hetero | FALSE | FALSE |
| Bacteroides_vulgatus | clade_378 | clade_309 | | hetero | FALSE | FALSE |
| Bacteroides_vulgatus | clade_378 | clade_500 | ++ | hetero | FALSE | TRUE |
| Bacteroides_vulgatus | clade_378 | clade_309 | ++ | homo | FALSE | TRUE |
| Collinsella_aerofaciens | clade_553 | clade_553 | +++ | hetero | TRUE | TRUE |
| Collinsella_aerofaciens | clade_553 | clade_92 | ++++ | hetero | FALSE | FALSE |
| Collinsella_aerofaciens | clade_553 | clade_309 | ++++ | hetero | FALSE | FALSE |
| Collinsella_aerofaciens | clade_553 | clade_170 | ++++ | hetero | FALSE | TRUE |
| Collinsella_aerofaciens | clade_553 | clade_85 | ++++ | hetero | TRUE | FALSE |
| Collinsella_aerofaciens | clade_553 | clade_262 | ++++ | hetero | FALSE | TRUE |
| Collinsella_aerofaciens | clade_553 | clade_408 | ++++ | hetero | TRUE | TRUE |
| Collinsella_aerofaciens | clade_553 | clade_172 | ++++ | hetero | TRUE | TRUE |
| Collinsella_aerofaciens | clade_553 | clade_262 | +++ | hetero | FALSE | TRUE |
| Collinsella_aerofaciens | clade_553 | clade_408 | ++++ | hetero | FALSE | TRUE |
| Collinsella_aerofaciens | clade_553 | clade_444 | ++++ | hetero | FALSE | TRUE |
| Collinsella_aerofaciens | clade_553 | clade_478 | ++++ | hetero | FALSE | TRUE |
| Collinsella_aerofaciens | clade_553 | clade_466 | ++++ | hetero | FALSE | TRUE |
| Collinsella_aerofaciens | clade_553 | clade_260 | ++++ | hetero | FALSE | TRUE |
| Collinsella_aerofaciens | clade_553 | clade_309 | +++ | hetero | TRUE | TRUE |
| Collinsella_aerofaciens | clade_553 | clade_500 | ++++ | hetero | FALSE | TRUE |
| Collinsella_aerofaciens | clade_553 | clade_309 | ++++ | hetero | FALSE | TRUE |
| Escherichia_coli | clade_92 | clade_92 | +++ | homo | FALSE | FALSE |
| Escherichia_coli | clade_92 | clade_309 | ++++ | hetero | FALSE | TRUE |
| Escherichia_coli | clade_92 | clade_170 | ++++ | hetero | TRUE | TRUE |
| Escherichia_coli | clade_92 | clade_85 | ++++ | hetero | TRUE | TRUE |
| Escherichia_coli | clade_92 | clade_262 | ++++ | hetero | FALSE | FALSE |
| Escherichia_coli | clade_92 | clade_408 | ++++ | hetero | FALSE | FALSE |
| Escherichia_coli | clade_92 | clade_172 | ++++ | hetero | TRUE | TRUE |
| Escherichia_coli | clade_92 | clade_262 | ++++ | hetero | FALSE | FALSE |
| Escherichia_coli | clade_92 | clade_408 | +++ | hetero | FALSE | TRUE |
| Escherichia_coli | clade_92 | clade_444 | ++++ | hetero | FALSE | TRUE |
| Escherichia_coli | clade_92 | clade_478 | + | hetero | FALSE | FALSE |
| Escherichia_coli | clade_92 | clade_466 | +++ | hetero | FALSE | TRUE |
| Escherichia_coli | clade_92 | clade_260 | ++++ | hetero | FALSE | TRUE |
| Escherichia_coli | clade_92 | clade_500 | +++ | hetero | TRUE | TRUE |
| Escherichia_coli | clade_92 | clade_309 | ++++ | hetero | FALSE | FALSE |

TABLE 4a-continued

| | | | | | |
|---|---|---|---|---|---|
| Ruminococcus_obeum | clade_309 | clade_309 | homo | ++++ | TRUE | FALSE |
| Ruminococcus_obeum | clade_309 | clade_170 | hetero | ++++ | TRUE | FALSE |
| Ruminococcus_obeum | clade_309 | clade_85 | hetero | ++++ | TRUE | FALSE |
| Ruminococcus_obeum | clade_309 | clade_262 | hetero | ++++ | TRUE | FALSE |
| Ruminococcus_obeum | clade_309 | clade_408 | hetero | ++++ | TRUE | TRUE |
| Ruminococcus_obeum | clade_309 | clade_172 | hetero | +++ | FALSE | FALSE |
| Ruminococcus_obeum | clade_309 | clade_172 | hetero | ++++ | TRUE | FALSE |
| Ruminococcus_obeum | clade_309 | clade_262 | hetero | ++++ | TRUE | TRUE |
| Ruminococcus_obeum | clade_309 | clade_408 | hetero | +++ | FALSE | FALSE |
| Ruminococcus_obeum | clade_309 | clade_444 | hetero | + | FALSE | FALSE |
| Ruminococcus_obeum | clade_309 | clade_478 | hetero | | FALSE | FALSE |
| Ruminococcus_obeum | clade_309 | clade_466 | hetero | | FALSE | FALSE |
| Ruminococcus_obeum | clade_309 | clade_260 | hetero | | FALSE | FALSE |
| Ruminococcus_obeum | clade_309 | clade_309 | hetero | | FALSE | FALSE |
| Ruminococcus_obeum | clade_309 | clade_500 | hetero | | FALSE | FALSE |
| Ruminococcus_obeum | clade_309 | clade_309 | hetero | | FALSE | FALSE |
| Bacteroides_caccae | clade_170 | clade_170 | homo | ++++ | TRUE | FALSE |
| Bacteroides_caccae | clade_170 | clade_85 | hetero | ++++ | TRUE | FALSE |
| Bacteroides_caccae | clade_170 | clade_262 | hetero | ++++ | TRUE | FALSE |
| Bacteroides_caccae | clade_170 | clade_408 | hetero | ++++ | FALSE | FALSE |
| Bacteroides_caccae | clade_170 | clade_172 | hetero | ++++ | TRUE | FALSE |
| Bacteroides_caccae | clade_170 | clade_172 | hetero | +++ | FALSE | FALSE |
| Bacteroides_caccae | clade_170 | clade_262 | hetero | ++ | FALSE | FALSE |
| Bacteroides_caccae | clade_170 | clade_408 | hetero | | FALSE | FALSE |
| Bacteroides_caccae | clade_170 | clade_444 | hetero | | FALSE | FALSE |
| Bacteroides_caccae | clade_170 | clade_478 | hetero | | FALSE | FALSE |
| Bacteroides_caccae | clade_170 | clade_466 | hetero | | FALSE | FALSE |
| Bacteroides_caccae | clade_170 | clade_260 | hetero | | FALSE | FALSE |
| Bacteroides_caccae | clade_170 | clade_309 | hetero | | FALSE | FALSE |
| Bacteroides_caccae | clade_170 | clade_500 | hetero | | FALSE | FALSE |
| Bacteroides_caccae | clade_170 | clade_309 | homo | +++ | TRUE | FALSE |
| Bacteroides_eggerthii | clade_85 | clade_85 | hetero | ++++ | TRUE | FALSE |
| Bacteroides_eggerthii | clade_85 | clade_262 | hetero | ++++ | FALSE | FALSE |
| Bacteroides_eggerthii | clade_85 | clade_408 | hetero | ++++ | TRUE | FALSE |
| Bacteroides_eggerthii | clade_85 | clade_172 | hetero | ++ | FALSE | FALSE |
| Bacteroides_eggerthii | clade_85 | clade_172 | hetero | +++ | FALSE | FALSE |
| Bacteroides_eggerthii | clade_85 | clade_262 | hetero | | FALSE | FALSE |
| Bacteroides_eggerthii | clade_85 | clade_408 | hetero | | FALSE | FALSE |
| Bacteroides_eggerthii | clade_85 | clade_444 | hetero | | FALSE | FALSE |
| Bacteroides_eggerthii | clade_85 | clade_478 | hetero | | FALSE | FALSE |
| Bacteroides_eggerthii | clade_85 | clade_466 | hetero | | FALSE | FALSE |
| Bacteroides_eggerthii | clade_85 | clade_260 | hetero | − | FALSE | FALSE |
| Bacteroides_eggerthii | clade_85 | clade_309 | hetero | − | FALSE | FALSE |
| Bacteroides_eggerthii | clade_85 | clade_500 | hetero | | FALSE | FALSE |
| Bacteroides_eggerthii | clade_85 | clade_309 | hetero | | FALSE | FALSE |
| Ruminococcus_torques | clade_262 | clade_262 | homo | ++++ | TRUE | FALSE |
| Ruminococcus_torques | clade_262 | clade_408 | hetero | ++++ | FALSE | FALSE |
| Ruminococcus_torques | clade_262 | clade_172 | hetero | ++++ | TRUE | TRUE |
| Ruminococcus_torques | clade_262 | clade_172 | hetero | ++++ | TRUE | FALSE |
| Ruminococcus_torques | clade_262 | clade_262 | hetero | ++++ | TRUE | FALSE |
| Ruminococcus_torques | clade_262 | clade_408 | hetero | + | FALSE | FALSE |
| Ruminococcus_torques | clade_262 | clade_444 | hetero | | FALSE | FALSE |
| Ruminococcus_torques | clade_262 | clade_478 | hetero | | FALSE | FALSE |

TABLE 4a-continued

| Species | | | | | | |
|---|---|---|---|---|---|---|
| Ruminococcus_torques | clade_262 | clade_466 | hetero | | FALSE | FALSE |
| Ruminococcus_torques | clade_262 | clade_260 | hetero | | FALSE | FALSE |
| Ruminococcus_torques | clade_262 | clade_309 | hetero | | FALSE | FALSE |
| Ruminococcus_torques | clade_262 | clade_500 | hetero | | FALSE | FALSE |
| Ruminococcus_torques | clade_262 | clade_309 | hetero | | FALSE | FALSE |
| Clostridium_hathewayi | clade_408 | clade_408 | homo | ++++ | TRUE | FALSE |
| Clostridium_hathewayi | clade_408 | clade_172 | hetero | ++++ | TRUE | TRUE |
| Clostridium_hathewayi | clade_408 | clade_172 | hetero | ++++ | TRUE | TRUE |
| Clostridium_hathewayi | clade_408 | clade_262 | hetero | +++ | FALSE | FALSE |
| Clostridium_hathewayi | clade_408 | clade_408 | hetero | ++++ | FALSE | TRUE |
| Clostridium_hathewayi | clade_408 | clade_444 | hetero | ++++ | FALSE | FALSE |
| Clostridium_hathewayi | clade_408 | clade_478 | hetero | ++ | FALSE | FALSE |
| Clostridium_hathewayi | clade_408 | clade_466 | hetero | +++ | FALSE | FALSE |
| Clostridium_hathewayi | clade_408 | clade_260 | hetero | +++ | FALSE | FALSE |
| Clostridium_hathewayi | clade_408 | clade_309 | hetero | ++ | FALSE | FALSE |
| Clostridium_hathewayi | clade_408 | clade_500 | hetero | ++ | FALSE | FALSE |
| Clostridium_hathewayi | clade_408 | clade_309 | hetero | ++++ | FALSE | FALSE |
| Bifidobacterium_pseudocatenulatum | clade_172 | clade_172 | homo | ++++ | TRUE | TRUE |
| Bifidobacterium_pseudocatenulatum | clade_172 | clade_172 | hetero | ++++ | TRUE | TRUE |
| Bifidobacterium_pseudocatenulatum | clade_172 | clade_262 | hetero | ++++ | FALSE | FALSE |
| Bifidobacterium_pseudocatenulatum | clade_172 | clade_408 | hetero | + | FALSE | FALSE |
| Bifidobacterium_pseudocatenulatum | clade_172 | clade_444 | hetero | | FALSE | FALSE |
| Bifidobacterium_pseudocatenulatum | clade_172 | clade_478 | hetero | ++ | FALSE | FALSE |
| Bifidobacterium_pseudocatenulatum | clade_172 | clade_466 | hetero | | FALSE | FALSE |
| Bifidobacterium_pseudocatenulatum | clade_172 | clade_260 | hetero | | FALSE | FALSE |
| Bifidobacterium_pseudocatenulatum | clade_172 | clade_309 | hetero | | FALSE | FALSE |
| Bifidobacterium_pseudocatenulatum | clade_172 | clade_500 | hetero | | FALSE | FALSE |
| Bifidobacterium_pseudocatenulatum | clade_172 | clade_309 | hetero | | FALSE | FALSE |
| Bifidobacterium_adolescentis | clade_172 | clade_172 | homo | ++++ | TRUE | TRUE |
| Bifidobacterium_adolescentis | clade_172 | clade_262 | hetero | ++++ | TRUE | FALSE |
| Bifidobacterium_adolescentis | clade_172 | clade_408 | hetero | ++++ | FALSE | TRUE |
| Bifidobacterium_adolescentis | clade_172 | clade_444 | hetero | ++++ | FALSE | FALSE |
| Bifidobacterium_adolescentis | clade_172 | clade_478 | hetero | | FALSE | FALSE |
| Bifidobacterium_adolescentis | clade_172 | clade_466 | hetero | ++++ | TRUE | FALSE |
| Bifidobacterium_adolescentis | clade_172 | clade_260 | hetero | ++++ | FALSE | FALSE |
| Bifidobacterium_adolescentis | clade_172 | clade_309 | hetero | + | FALSE | FALSE |
| Bifidobacterium_adolescentis | clade_172 | clade_500 | hetero | +++ | FALSE | FALSE |
| Bifidobacterium_adolescentis | clade_172 | clade_309 | hetero | +++ | FALSE | FALSE |
| Coprococcus_comes | clade_262 | clade_262 | homo | | FALSE | FALSE |
| Coprococcus_comes | clade_262 | clade_408 | hetero | ++ | FALSE | FALSE |
| Coprococcus_comes | clade_262 | clade_444 | hetero | + | FALSE | TRUE |
| Coprococcus_comes | clade_262 | clade_478 | hetero | + | FALSE | TRUE |
| Coprococcus_comes | clade_262 | clade_466 | hetero | | FALSE | FALSE |
| Coprococcus_comes | clade_262 | clade_260 | hetero | ++++ | FALSE | TRUE |
| Coprococcus_comes | clade_262 | clade_309 | hetero | | TRUE | TRUE |
| Coprococcus_comes | clade_262 | clade_500 | hetero | | FALSE | FALSE |
| Coprococcus_comes | clade_262 | clade_309 | hetero | ++++ | TRUE | TRUE |
| Clostridium_symbiosum | clade_408 | clade_408 | homo | ++ | FALSE | FALSE |
| Clostridium_symbiosum | clade_408 | clade_444 | hetero | + | FALSE | TRUE |
| Clostridium_symbiosum | clade_408 | clade_478 | hetero | +++ | FALSE | TRUE |
| Clostridium_symbiosum | clade_408 | clade_466 | hetero | + | FALSE | FALSE |
| Clostridium_symbiosum | clade_408 | clade_260 | hetero | +++ | FALSE | FALSE |
| Clostridium_symbiosum | clade_408 | clade_309 | hetero | | FALSE | FALSE |

TABLE 4a-continued

| | | | | | |
|---|---|---|---|---|---|
| Clostridium_symbiosum | clade_408 | clade_500 | hetero | | FALSE | FALSE |
| Clostridium_symbiosum | clade_408 | clade_309 | hetero | ++++ | TRUE | TRUE |
| Eubacterium_rectale | clade_444 | clade_444 | homo | + | FALSE | TRUE |
| Eubacterium_rectale | clade_444 | clade_478 | hetero | + | FALSE | FALSE |
| Eubacterium_rectale | clade_444 | clade_466 | hetero | + | FALSE | FALSE |
| Eubacterium_rectale | clade_444 | clade_260 | hetero | | FALSE | FALSE |
| Eubacterium_rectale | clade_444 | clade_309 | hetero | | FALSE | FALSE |
| Eubacterium_rectale | clade_444 | clade_500 | hetero | | FALSE | FALSE |
| Faecalibacterium_prausnitzii | clade_478 | clade_478 | homo | + | FALSE | TRUE |
| Faecalibacterium_prausnitzii | clade_478 | clade_466 | hetero | + | FALSE | TRUE |
| Faecalibacterium_prausnitzii | clade_478 | clade_260 | hetero | ++ | FALSE | TRUE |
| Faecalibacterium_prausnitzii | clade_478 | clade_309 | hetero | | FALSE | TRUE |
| Faecalibacterium_prausnitzii | clade_478 | clade_500 | hetero | | FALSE | TRUE |
| Odoribacter_splanchnicus | clade_466 | clade_466 | homo | ++++ | TRUE | TRUE |
| Odoribacter_splanchnicus | clade_466 | clade_260 | hetero | | FALSE | FALSE |
| Odoribacter_splanchnicus | clade_466 | clade_309 | hetero | | FALSE | FALSE |
| Odoribacter_splanchnicus | clade_466 | clade_500 | hetero | | FALSE | TRUE |
| Lachnospiraceae_bacterium_5_1_57FAA | clade_260 | clade_260 | homo | ++ | FALSE | FALSE |
| Lachnospiraceae_bacterium_5_1_57FAA | clade_260 | clade_309 | hetero | | FALSE | FALSE |
| Lachnospiraceae_bacterium_5_1_57FAA | clade_260 | clade_500 | hetero | ++++ | TRUE | TRUE |
| Blautia_schinkii | clade_309 | clade_309 | homo | | FALSE | TRUE |
| Blautia_schinkii | clade_309 | clade_500 | hetero | | FALSE | FALSE |
| Alistipes_shahii | clade_500 | clade_500 | homo | | FALSE | |
| Alistipes_shahii | clade_500 | clade_309 | hetero | | FALSE | FALSE |
| Blautia_producta | clade_309 | clade_309 | homo | ++++ | TRUE | FALSE |
| Collinsella_aerofaciens | clade_553 | clade_252 | hetero | | FALSE | FALSE |
| Collinsella_aerofaciens | clade_553 | clade_253 | hetero | − | FALSE | FALSE |
| Collinsella_aerofaciens | clade_553 | clade_351 | hetero | ++ | FALSE | FALSE |
| Collinsella_aerofaciens | clade_553 | clade_354 | hetero | ++++ | TRUE | TRUE |
| Collinsella_aerofaciens | clade_553 | clade_252 | hetero | ++++ | FALSE | TRUE |
| Collinsella_aerofaciens | clade_553 | clade_260 | hetero | ++++ | FALSE | TRUE |
| Collinsella_aerofaciens | clade_553 | clade_408 | hetero | ++++ | TRUE | TRUE |
| Collinsella_aerofaciens | clade_553 | clade_494 | hetero | ++++ | TRUE | TRUE |
| Collinsella_aerofaciens | clade_553 | clade_360 | hetero | ++++ | TRUE | TRUE |
| Collinsella_aerofaciens | clade_553 | clade_537 | hetero | ++++ | FALSE | TRUE |
| Collinsella_aerofaciens | clade_553 | clade_444 | hetero | ++++ | FALSE | TRUE |
| Clostridium_tertium | clade_252 | clade_553 | hetero | | FALSE | FALSE |
| Clostridium_tertium | clade_252 | clade_252 | homo | ++ | FALSE | TRUE |
| Clostridium_tertium | clade_252 | clade_253 | hetero | ++++ | FALSE | TRUE |
| Clostridium_tertium | clade_252 | clade_351 | hetero | ++++ | TRUE | TRUE |
| Clostridium_tertium | clade_252 | clade_354 | hetero | ++++ | TRUE | TRUE |
| Clostridium_tertium | clade_252 | clade_252 | hetero | ++++ | TRUE | TRUE |
| Clostridium_tertium | clade_252 | clade_262 | hetero | ++++ | TRUE | TRUE |
| Clostridium_tertium | clade_252 | clade_260 | hetero | ++++ | TRUE | TRUE |
| Clostridium_tertium | clade_252 | clade_408 | hetero | ++++ | TRUE | TRUE |
| Clostridium_tertium | clade_252 | clade_408 | hetero | + | TRUE | FALSE |
| Clostridium_tertium | clade_252 | clade_494 | hetero | ++++ | TRUE | TRUE |
| Clostridium_tertium | clade_252 | clade_478 | hetero | ++++ | TRUE | TRUE |

TABLE 4a-continued

| | | | | | |
|---|---|---|---|---|---|
| Clostridium_tertium | clade_252 | clade_260 | hetero | ++++ | TRUE | TRUE |
| Clostridium_tertium | clade_252 | clade_309 | hetero | ++++ | TRUE | TRUE |
| Clostridium_tertium | clade_252 | clade_360 | hetero | ++++ | TRUE | TRUE |
| Clostridium_tertium | clade_252 | clade_537 | hetero | ++++ | TRUE | TRUE |
| Clostridium_tertium | clade_252 | clade_444 | hetero | ++++ | TRUE | TRUE |
| Clostridium_disporicum | clade_252 | clade_252 | homo | + | FALSE | FALSE |
| Clostridium_disporicum | clade_253 | clade_253 | hetero | ++ | FALSE | TRUE |
| Clostridium_disporicum | clade_253 | clade_351 | hetero | ++++ | TRUE | TRUE |
| Clostridium_disporicum | clade_253 | clade_354 | hetero | ++++ | TRUE | TRUE |
| Clostridium TABLE 4a-continued

| | | | | | |
|---|---|---|---|---|---|
| Clostridium_butyricum | clade_252 | clade_260 | hetero | ++++ | TRUE | TRUE TABLE 4a-continued

| | | | | | |
|---|---|---|---|---|---|
| Faecalibacterium_prausnitzii | clade_478 | clade_537 | | | FALSE | FALSE |
| Faecalibacterium_prausnitzii | clade_478 | clade_444 | | | FALSE | TRUE |
| Lachnospiraceae_bacterium_5_1_57FAA | clade_260 | clade_360 | hetero | ++++ | FALSE | TRUE |
| Lachnospiraceae_bacterium_5_1_57FAA | clade_260 | clade_537 | hetero | +++ | FALSE | TRUE |
| Lachnospiraceae_bacterium_5_1_57FAA | clade_260 | clade_444 | hetero | ++++ | FALSE | TRUE |
| Blautia_producta | clade_309 | clade_360 | hetero | ++ | TRUE | TRUE |
| Blautia_producta | clade_309 | clade_537 | hetero | ++++ | TRUE | TRUE |
| Blautia_producta | clade_309 | clade_444 | hetero | ++++ | TRUE | TRUE |
| Ruminococcus_gnavus | clade_360 | clade_309 | homo | + | TRUE | TRUE |
| Ruminococcus_gnavus | clade_360 | clade_537 | hetero | +++ | FALSE | TRUE |
| Ruminococcus_gnavus | clade_360 | clade_444 | hetero | +++ | FALSE | TRUE |
| Ruminococcus_bromii | clade_537 | clade_360 | hetero | +++ | FALSE | |
| Ruminococcus_bromii | clade_537 | clade_309 | homo | | FALSE | |
| Ruminococcus_bromii | clade_537 | clade_444 | hetero | | FALSE | TRUE |
| Eubacterium_rectale | clade_444 | clade_537 | hetero | | FALSE | TRUE |
| Eubacterium_rectale | clade_444 | clade_553 | homo | ++ | FALSE | |
| Collinsella_aerofaciens | clade_553 | clade_262 | semi | ++ | FALSE | FALSE |
| Collinsella_aerofaciens | clade_553 | clade_408 | semi | ++++ | FALSE | FALSE |
| Collinsella_aerofaciens | clade_553 | clade_408 | semi | +++ | FALSE | FALSE |
| Collinsella_aerofaciens | clade_553 | clade_478 | semi | ++++ | FALSE | TRUE |
| Collinsella_aerofaciens | clade_553 | clade_260 | semi | ++++ | FALSE | FALSE |
| Collinsella_aerofaciens | clade_553 | clade_309 | semi | ++++ | FALSE | TRUE |
| Collinsella_aerofaciens | clade_553 | clade_444 | semi | ++++ | FALSE | FALSE |
| Collinsella_aerofaciens | clade_553 | clade_553 | semi | | FALSE | FALSE |
| Collinsella_aerofaciens | clade_553 | clade_262 | hetero | ++++ | FALSE | FALSE |
| Collinsella_aerofaciens | clade_553 | clade_408 | hetero | +++ | FALSE | FALSE |
| Collinsella_aerofaciens | clade_553 | clade_262 | hetero | ++++ | FALSE | TRUE |
| Collinsella_aerofaciens | clade_553 | clade_478 | hetero | +++ | FALSE | FALSE |
| Collinsella_aerofaciens | clade_553 | clade_260 | hetero | ++++ | FALSE | TRUE |
| Collinsella_aerofaciens | clade_553 | clade_408 | hetero | +++ | FALSE | FALSE |
| Collinsella_aerofaciens | clade_553 | clade_309 | semi | ++++ | FALSE | FALSE |
| Collinsella_aerofaciens | clade_553 | clade_444 | hetero | ++++ | FALSE | FALSE |
| Collinsella_aerofaciens | clade_553 | clade_408 | hetero | ++++ | FALSE | FALSE |
| Collinsella_aerofaciens | clade_553 | clade_408 | hetero | ++++ | FALSE | FALSE |
| Collinsella_aerofaciens | clade_553 | clade_478 | semi | + | FALSE | TRUE |
| Collinsella_aerofaciens | clade_553 | clade_408 | hetero | ++++ | FALSE | TRUE |
| Collinsella_aerofaciens | clade_553 | clade_309 | semi | +++ | FALSE | TRUE |
| Collinsella_aerofaciens | clade_553 | clade_444 | hetero | +++ | TRUE | FALSE |
| Collinsella_aerofaciens | clade_553 | clade_478 | hetero | ++++ | FALSE | TRUE |
| Collinsella_aerofaciens | clade_553 | clade_260 | semi | ++++ | FALSE | FALSE |
| Collinsella_aerofaciens | clade_553 | clade_260 | semi | ++++ | FALSE | TRUE |
| Collinsella_aerofaciens | clade_553 | clade_444 | hetero | ++++ | FALSE | FALSE |
| Collinsella_aerofaciens | clade_553 | clade_309 | semi | ++++ | FALSE | TRUE |
| Collinsella_aerofaciens | clade_553 | clade_444 | hetero | + | FALSE | TRUE |

TABLE 4a-continued

| | | | | | |
|---|---|---|---|---|---|
| Coprococcus_comes | clade_262 | clade_262 | clade_262 | homo | | FALSE | FALSE |
| Coprococcus_comes | clade_262 | clade_262 | clade_408 | semi | | FALSE | FALSE |
| Coprococcus_comes | clade_262 | clade_262 | clade_408 | semi | | FALSE | FALSE |
| Coprococcus_comes | clade_262 | clade_262 | clade_478 | semi | | FALSE | FALSE |
| Coprococcus_comes | clade_262 | clade_262 | clade_260 | semi | | FALSE | FALSE |
| Coprococcus_comes | clade_262 | clade_262 | clade_309 | semi | ++++ | FALSE | TRUE |
| Coprococcus_comes | clade_262 | clade_262 | clade_444 | semi | −− | FALSE | FALSE |
| Coprococcus_comes | clade_262 | clade_262 | clade_408 | semi | ++ | FALSE | FALSE |
| Coprococcus_comes | clade_262 | clade_262 | clade_408 | hetero | +++ | FALSE | FALSE |
| Coprococcus_comes | clade_262 | clade_262 | clade_478 | hetero | +++ | FALSE | FALSE |
| Coprococcus_comes | clade_262 | clade_262 | clade_260 | hetero | ++++ | FALSE | FALSE |
| Coprococcus_comes | clade_262 | clade_262 | clade_309 | hetero | −− | FALSE | FALSE |
| Coprococcus_comes | clade_262 | clade_262 | clade_444 | semi | | FALSE | FALSE |
| Coprococcus_comes | clade_262 | clade_262 | clade_408 | hetero | ++++ | FALSE | FALSE |
| Coprococcus_comes | clade_262 | clade_262 | clade_478 | hetero | −−− | FALSE | FALSE |
| Coprococcus_comes | clade_262 | clade_262 | clade_260 | semi | −−− | FALSE | FALSE |
| Coprococcus_comes | clade_262 | clade_262 | clade_309 | hetero | ++++ | FALSE | FALSE |
| Coprococcus_comes | clade_262 | clade_262 | clade_444 | hetero | ++++ | FALSE | TRUE |
| Coprococcus_comes | clade_262 | clade_262 | clade_478 | hetero | −, | FALSE | FALSE |
| Coprococcus_comes | clade_262 | clade_262 | clade_260 | semi | + | FALSE | FALSE |
| Coprococcus_comes | clade_262 | clade_262 | clade_309 | hetero | ++++ | FALSE | TRUE |
| Coprococcus_comes | clade_262 | clade_262 | clade_444 | semi | ++++ | FALSE | FALSE |
| Coprococcus_comes | clade_262 | clade_262 | clade_309 | semi | ++++ | FALSE | FALSE |
| Coprococcus_comes | clade_262 | clade_262 | clade_444 | hetero | , | FALSE | FALSE |
| Clostridium_bolteae | clade_408 | clade_408 | clade_408 | homo | | FALSE | FALSE |
| Clostridium_bolteae | clade_408 | clade_408 | clade_408 | semi | ++++ | FALSE | FALSE |
| Clostridium_bolteae | clade_408 | clade_408 | clade_478 | semi | ++ | FALSE | FALSE |
| Clostridium_bolteae | clade_408 | clade_408 | clade_260 | semi | ++ | FALSE | FALSE |
| Clostridium_bolteae | clade_408 | clade_408 | clade_309 | semi | ++++ | FALSE | FALSE |
| Clostridium_bolteae | clade_408 | clade_408 | clade_444 | semi | | FALSE | FALSE |
| Clostridium_bolteae | clade_408 | clade_408 | clade_408 | semi | | FALSE | FALSE |
| Clostridium_bolteae | clade_408 | clade_408 | clade_478 | hetero | | FALSE | FALSE |
| Clostridium_bolteae | clade_408 | clade_408 | clade_260 | hetero | ++++ | FALSE | FALSE |
| Clostridium_bolteae | clade_408 | clade_408 | clade_309 | hetero | , | FALSE | FALSE |
| Clostridium_bolteae | clade_408 | clade_408 | clade_444 | semi | ++++ | FALSE | FALSE |
| Clostridium_bolteae | clade_408 | clade_408 | clade_478 | semi | ++++ | FALSE | TRUE |
| Clostridium_bolteae | clade_408 | clade_408 | clade_260 | semi | ++ | FALSE | FALSE |
| Clostridium_bolteae | clade_408 | clade_408 | clade_309 | hetero | ++++ | FALSE | FALSE |
| Clostridium_bolteae | clade_408 | clade_408 | clade_444 | hetero | + | FALSE | FALSE |
| Clostridium_bolteae | clade_408 | clade_309 | clade_309 | semi | ++++ | FALSE | FALSE |
| Clostridium_bolteae | clade_408 | clade_444 | clade_444 | hetero | ++++ | FALSE | TRUE |
| Clostridium_symbiosum | clade_408 | clade_408 | clade_408 | homo | −− | FALSE | FALSE |
| Clostridium_symbiosum | clade_408 | clade_478 | clade_478 | semi | + | FALSE | FALSE |
| Clostridium_symbiosum | clade_408 | clade_260 | clade_260 | semi | | FALSE | FALSE |
| Clostridium_symbiosum | clade_408 | clade_408 | clade_309 | semi | ++++ | FALSE | FALSE |

TABLE 4a-continued

| Species | Clade A | Clade B | Type | Mark | Col1 | Col2 |
|---|---|---|---|---|---|---|
| Clostridium_symbiosum | clade_408 | clade_408 | semi | | FALSE | FALSE |
| Clostridium_symbiosum | clade_408 | clade_478 | semi | | FALSE | FALSE |
| Clostridium_symbiosum | clade_408 | clade_260 | hetero | + | FALSE | FALSE |
| Clostridium_symbiosum | clade_408 | clade_309 | hetero | ++++ | FALSE | TRUE |
| Clostridium_symbiosum | clade_408 | clade_444 | semi | | FALSE | FALSE |
| Clostridium_symbiosum | clade_408 | clade_260 | semi | | FALSE | FALSE |
| Clostridium_symbiosum | clade_408 | clade_309 | hetero | +++ | FALSE | TRUE |
| Clostridium_symbiosum | clade_408 | clade_444 | semi | ++++ | FALSE | FALSE |
| Clostridium_symbiosum | clade_408 | clade_309 | semi | ++++ | FALSE | TRUE |
| Clostridium_symbiosum | clade_408 | clade_444 | hetero | +++ | FALSE | FALSE |
| Clostridium_symbiosum | clade_408 | clade_478 | semi | | FALSE | FALSE |
| Faecalibacterium_prausnitzii | clade_478 | clade_260 | homo | − | FALSE | FALSE |
| Faecalibacterium_prausnitzii | clade_478 | clade_478 | semi | ++++ | FALSE | TRUE |
| Faecalibacterium_prausnitzii | clade_478 | clade_309 | semi | −−− | FALSE | FALSE |
| Faecalibacterium_prausnitzii | clade_478 | clade_260 | semi | | FALSE | FALSE |
| Faecalibacterium_prausnitzii | clade_478 | clade_260 | semi | +++ | FALSE | FALSE |
| Faecalibacterium_prausnitzii | clade_478 | clade_309 | hetero | ++++ | FALSE | TRUE |
| Faecalibacterium_prausnitzii | clade_478 | clade_444 | semi | ++++ | FALSE | FALSE |
| Faecalibacterium_prausnitzii | clade_478 | clade_309 | semi | +++ | FALSE | TRUE |
| Faecalibacterium_prausnitzii | clade_478 | clade_444 | hetero | ++++ | FALSE | FALSE |
| Lachnospiraceae_bacterium_5_1_57FAA | clade_260 | clade_444 | semi | − | FALSE | FALSE |
| Lachnospiraceae_bacterium_5_1_57FAA | clade_260 | clade_260 | homo | +++ | FALSE | TRUE |
| Lachnospiraceae_bacterium_5_1_57FAA | clade_260 | clade_309 | semi | ++++ | FALSE | FALSE |
| Lachnospiraceae_bacterium_5_1_57FAA | clade_260 | clade_260 | semi | + | FALSE | FALSE |
| Lachnospiraceae_bacterium_5_1_57FAA | clade_260 | clade_309 | hetero | ++++ | FALSE | FALSE |
| Lachnospiraceae_bacterium_5_1_57FAA | clade_260 | clade_444 | hetero | ++++ | FALSE | FALSE |
| Blautia_producta | clade_309 | clade_309 | homo | ++++ | FALSE | TRUE |
| Blautia_producta | clade_309 | clade_444 | semi | ++++ | FALSE | TRUE |
| Eubacterium_rectale | clade_444 | clade_444 | homo | ++++ | FALSE | FALSE |
| Collinsella_aerofaciens | clade_553 | clade_252 | semi | +++ | FALSE | FALSE |
| Collinsella_aerofaciens | clade_553 | clade_253 | hetero | ++++ | FALSE | FALSE |
| Collinsella_aerofaciens | clade_553 | clade_351 | hetero | ++++ | FALSE | FALSE |
| Collinsella_aerofaciens | clade_553 | clade_354 | hetero | ++++ | FALSE | TRUE |
| Collinsella_aerofaciens | clade_553 | clade_252 | hetero | ++++ | FALSE | TRUE |
| Collinsella_aerofaciens | clade_553 | clade_260 | hetero | ++++ | TRUE | TRUE |
| Collinsella_aerofaciens | clade_553 | clade_494 | hetero | ++++ | FALSE | TRUE |
| Collinsella_aerofaciens | clade_553 | clade_252 | hetero | ++++ | FALSE | TRUE |
| Collinsella_aerofaciens | clade_553 | clade_360 | hetero | ++++ | FALSE | TRUE |
| Collinsella_aerofaciens | clade_553 | clade_537 | hetero | ++++ | FALSE | FALSE |
| Collinsella_aerofaciens | clade_553 | clade_309 | hetero | ++++ | FALSE | FALSE |
| Collinsella_aerofaciens | clade_553 | clade_253 | semi | +++ | FALSE | FALSE |
| Collinsella_aerofaciens | clade_553 | clade_351 | hetero | ++++ | FALSE | FALSE |
| Collinsella_aerofaciens | clade_553 | clade_354 | hetero | ++++ | FALSE | TRUE |
| Collinsella_aerofaciens | clade_553 | clade_252 | hetero | ++++ | FALSE | FALSE |
| Collinsella_aerofaciens | clade_553 | clade_260 | hetero | ++++ | FALSE | FALSE |
| Collinsella_aerofaciens | clade_553 | clade_494 | hetero | ++++ | FALSE | FALSE |
| Collinsella_aerofaciens | clade_553 | clade_360 | hetero | ++++ | FALSE | FALSE |
| Collinsella_aerofaciens | clade_553 | clade_537 | hetero | ++++ | FALSE | FALSE |
| Collinsella_aerofaciens | clade_553 | clade_309 | semi | ++++ | FALSE | FALSE |
| Collinsella_aerofaciens | clade_553 | clade_351 | hetero | ++++ | FALSE | FALSE |
| Collinsella_aerofaciens | clade_553 | clade_354 | hetero | ++++ | FALSE | FALSE |
| Collinsella_aerofaciens | clade_553 | clade_252 | hetero | ++++ | TRUE | TRUE |

TABLE 4a-continued

| Species | Clade A | Clade B | Type | Score | Col1 | Col2 |
|---|---|---|---|---|---|---|
| Collinsella_aerofaciens | clade_553 | clade_351 | hetero | ++++ | FALSE | FALSE |
| Collinsella_aerofaciens | clade_553 | clade_351 | hetero | ++++ | FALSE | TRUE |
| Collinsella_aerofaciens | clade_553 | clade_351 | hetero | ++++ | FALSE | FALSE |
| Collinsella_aerofaciens | clade_553 | clade_351 | hetero | ++++ | FALSE | TRUE |
| Collinsella_aerofaciens | clade_553 | clade_354 | semi | ++++ | TRUE | FALSE |
| Collinsella_aerofaciens | clade_553 | clade_354 | hetero | ++++ | FALSE | FALSE |
| Collinsella_aerofaciens | clade_553 | clade_354 | hetero | ++++ | FALSE | FALSE |
| Collinsella_aerofaciens | clade_553 | clade_354 | hetero | ++++ | FALSE | TRUE |
| Collinsella_aerofaciens | clade_553 | clade_354 | hetero | ++++ | FALSE | FALSE |
| Collinsella_aerofaciens | clade_553 | clade_354 | hetero | ++++ | FALSE | TRUE |
| Collinsella_aerofaciens | clade_553 | clade_252 | semi | ++++ | TRUE | FALSE |
| Collinsella_aerofaciens | clade_553 | clade_252 | hetero | ++++ | TRUE | TRUE |
| Collinsella_aerofaciens | clade_553 | clade_252 | hetero | ++++ | TRUE | TRUE |
| Collinsella_aerofaciens | clade_553 | clade_252 | hetero | ++++ | TRUE | TRUE |
| Collinsella_aerofaciens | clade_553 | clade_260 | semi | ++ | FALSE | TRUE |
| Collinsella_aerofaciens | clade_553 | clade_260 | hetero | ++++ | FALSE | TRUE |
| Collinsella_aerofaciens | clade_553 | clade_260 | hetero | ++++ | FALSE | TRUE |
| Collinsella_aerofaciens | clade_553 | clade_260 | hetero | ++++ | FALSE | TRUE |
| Collinsella_aerofaciens | clade_553 | clade_494 | semi | ++++ | FALSE | TRUE |
| Collinsella_aerofaciens | clade_553 | clade_494 | hetero | ++++ | FALSE | TRUE |
| Collinsella_aerofaciens | clade_553 | clade_494 | hetero | ++++ | FALSE | TRUE |
| Collinsella_aerofaciens | clade_553 | clade_494 | hetero | ++++ | FALSE | TRUE |
| Collinsella_aerofaciens | clade_553 | clade_360 | hetero | ++++ | FALSE | TRUE |
| Collinsella_aerofaciens | clade_553 | clade_360 | semi | ++++ | FALSE | TRUE |
| Collinsella_aerofaciens | clade_553 | clade_360 | hetero | ++++ | FALSE | FALSE |
| Collinsella_aerofaciens | clade_553 | clade_537 | hetero | ---- | FALSE | FALSE |
| Collinsella_aerofaciens | clade_553 | clade_537 | semi | ---- | FALSE | FALSE |
| Collinsella_aerofaciens | clade_553 | clade_309 | hetero | ++++ | TRUE | TRUE |
| Collinsella_aerofaciens | clade_553 | clade_309 | hetero | ++++ | TRUE | TRUE |
| Coprococcus_comes | clade_262 | clade_252 | hetero | ++++ | FALSE | TRUE |
| Coprococcus_comes | clade_262 | clade_252 | hetero | ++++ | FALSE | FALSE |
| Coprococcus_comes | clade_262 | clade_252 | hetero | ++ | FALSE | TRUE |
| Coprococcus_comes | clade_262 | clade_252 | hetero | ++++ | FALSE | FALSE |
| Coprococcus_comes | clade_262 | clade_253 | semi | ---- | FALSE | FALSE |
| Coprococcus_comes | clade_262 | clade_253 | hetero | ---- | FALSE | FALSE |
| Coprococcus_comes | clade_262 | clade_351 | hetero | ++++ | FALSE | TRUE |
| Coprococcus_comes | clade_262 | clade_351 | hetero | ---- | FALSE | FALSE |
| Coprococcus_comes | clade_262 | clade_354 | hetero | ---- | FALSE | FALSE |
| Coprococcus_comes | clade_262 | clade_252 | semi | ++ | FALSE | FALSE |
| Coprococcus_comes | clade_262 | clade_260 | hetero | ---- | FALSE | FALSE |
| Coprococcus_comes | clade_262 | clade_351 | hetero | ++++ | TRUE | TRUE |
| Coprococcus_comes | clade_262 | clade_351 | hetero | ---- | FALSE | FALSE |

TABLE 4a-continued

| Organism | | | | | | | |
|---|---|---|---|---|---|---|---|
| Coprococcus_comes | clade_262 | clade_351 | clade_494 | hetero | −− | FALSE | FALSE |
| Coprococcus_comes | clade_262 | clade_351 | clade_360 | hetero | ++++ | FALSE | FALSE |
| Coprococcus_comes | clade_262 | clade_351 | clade_537 | hetero | ++++ | FALSE | TRUE |
| Coprococcus_comes | clade_262 | clade_351 | clade_309 | hetero | ++++ | FALSE | FALSE |
| Coprococcus_comes | clade_262 | clade_354 | clade_252 | semi | ++++ | TRUE | TRUE |
| Coprococcus_comes | clade_262 | clade_354 | clade_260 | hetero | ++++ | FALSE | TRUE |
| Coprococcus_comes | clade_262 | clade_354 | clade_494 | hetero | ++++ | FALSE | TRUE |
| Coprococcus_comes | clade_262 | clade_354 | clade_360 | hetero | ++++ | FALSE | FALSE |
| Coprococcus_comes | clade_262 | clade_354 | clade_537 | hetero | ++++ | FALSE | TRUE |
| Coprococcus_comes | clade_262 | clade_354 | clade_309 | hetero | ++++ | TRUE | FALSE |
| Coprococcus_comes | clade_262 | clade_252 | clade_260 | semi | ++++ | TRUE | TRUE |
| Coprococcus_comes | clade_262 | clade_252 | clade_494 | hetero | ++++ | TRUE | TRUE |
| Coprococcus_comes | clade_262 | clade_252 | clade_360 | hetero | ++++ | TRUE | TRUE |
| Coprococcus_comes | clade_262 | clade_252 | clade_537 | hetero | ++++ | TRUE | TRUE |
| Coprococcus_comes | clade_262 | clade_252 | clade_309 | hetero | ++++ | TRUE | TRUE |
| Coprococcus_comes | clade_262 | clade_260 | clade_494 | semi | ++++ | FALSE | TRUE |
| Coprococcus_comes | clade_262 | clade_260 | clade_360 | hetero | +++ | FALSE | FALSE |
| Coprococcus_comes | clade_262 | clade_260 | clade_537 | hetero | + | FALSE | TRUE |
| Coprococcus_comes | clade_262 | clade_494 | clade_309 | hetero | ++++ | FALSE | TRUE |
| Coprococcus_comes | clade_262 | clade_494 | clade_360 | semi | −−−− | FALSE | FALSE |
| Coprococcus_comes | clade_262 | clade_494 | clade_537 | hetero | ++++ | FALSE | FALSE |
| Coprococcus_comes | clade_262 | clade_360 | clade_309 | hetero | −− | FALSE | FALSE |
| Coprococcus_comes | clade_262 | clade_360 | clade_537 | semi | ++++ | FALSE | FALSE |
| Coprococcus_comes | clade_262 | clade_537 | clade_309 | hetero | ++++ | FALSE | FALSE |
| Clostridium_bolteae | clade_408 | clade_252 | clade_309 | hetero | ++++ | FALSE | FALSE |
| Clostridium_bolteae | clade_408 | clade_252 | clade_253 | semi | ++++ | FALSE | FALSE |
| Clostridium_bolteae | clade_408 | clade_252 | clade_351 | hetero | ++++ | FALSE | FALSE |
| Clostridium_bolteae | clade_408 | clade_252 | clade_354 | hetero | ++++ | FALSE | FALSE |
| Clostridium_bolteae | clade_408 | clade_252 | clade_252 | hetero | ++++ | TRUE | TRUE |
| Clostridium_bolteae | clade_408 | clade_252 | clade_260 | hetero | ++++ | FALSE | TRUE |
| Clostridium_bolteae | clade_408 | clade_252 | clade_494 | hetero | ++++ | FALSE | TRUE |
| Clostridium_bolteae | clade_408 | clade_252 | clade_360 | hetero | ++++ | FALSE | TRUE |
| Clostridium_bolteae | clade_408 | clade_252 | clade_537 | hetero | ++++ | FALSE | TRUE |
| Clostridium_bolteae | clade_408 | clade_252 | clade_309 | hetero | ++++ | FALSE | TRUE |
| Clostridium_bolteae | clade_408 | clade_253 | clade_252 | semi | +++ | FALSE | FALSE |
| Clostridium_bolteae | clade_408 | clade_253 | clade_351 | hetero | − | FALSE | FALSE |
| Clostridium_bolteae | clade_408 | clade_253 | clade_354 | hetero | ++++ | FALSE | FALSE |
| Clostridium_bolteae | clade_408 | clade_253 | clade_252 | hetero | ++++ | TRUE | TRUE |
| Clostridium_bolteae | clade_408 | clade_253 | clade_260 | hetero | | FALSE | FALSE |
| Clostridium_bolteae | clade_408 | clade_253 | clade_494 | hetero | ++++ | FALSE | FALSE |
| Clostridium_bolteae | clade_408 | clade_253 | clade_360 | hetero | ++++ | FALSE | FALSE |
| Clostridium_bolteae | clade_408 | clade_253 | clade_537 | hetero | ++++ | FALSE | FALSE |
| Clostridium_bolteae | clade_408 | clade_253 | clade_309 | hetero | ++++ | FALSE | FALSE |
| Clostridium_bolteae | clade_408 | clade_351 | clade_354 | semi | ++++ | FALSE | FALSE |
| Clostridium_bolteae | clade_408 | clade_351 | clade_252 | hetero | −−−− | FALSE | FALSE |
| Clostridium_bolteae | clade_408 | clade_351 | clade_260 | hetero | ++++ | TRUE | TRUE |
| Clostridium_bolteae | clade_408 | clade_351 | clade_494 | hetero | −− | FALSE | FALSE |
| Clostridium_bolteae | clade_408 | clade_351 | clade_351 | hetero | −− | FALSE | FALSE |

TABLE 4a-continued

| | | | | | |
|---|---|---|---|---|---|
| Clostridium_bolteae | clade_408 | clade_351 | clade_360 | hetero | ++++ | FALSE | FALSE |
| Clostridium_bolteae | clade_408 | clade_351 | clade_537 | hetero | ++++ | FALSE | FALSE |
| Clostridium_bolteae | clade_408 | clade_351 | clade_309 | hetero | ++++ | FALSE | FALSE |
| Clostridium_bolteae | clade_408 | clade_354 | clade_354 | semi | ++++ | FALSE | FALSE |
| Clostridium_bolteae | clade_408 | clade_354 | clade_252 | hetero | ++++ | TRUE | FALSE |
| Clostridium_bolteae | clade_408 | clade_354 | clade_260 | hetero | ++++ | FALSE | FALSE |
| Clostridium_bolteae | clade_408 | clade_354 | clade_494 | hetero | ++++ | FALSE | FALSE |
| Clostridium_bolteae | clade_408 | clade_354 | clade_360 | hetero | ++++ | FALSE | FALSE |
| Clostridium_bolteae | clade_408 | clade_354 | clade_537 | hetero | ++++ | FALSE | FALSE |
| Clostridium_bolteae | clade_408 | clade_354 | clade_309 | hetero | ++++ | TRUE | TRUE |
| Clostridium_bolteae | clade_408 | clade_252 | clade_252 | semi | ++++ | TRUE | FALSE |
| Clostridium_bolteae | clade_408 | clade_252 | clade_260 | hetero | ++++ | TRUE | TRUE |
| Clostridium_bolteae | clade_408 | clade_252 | clade_494 | hetero | ++++ | TRUE | TRUE |
| Clostridium_bolteae | clade_408 | clade_252 | clade_360 | hetero | ++++ | TRUE | TRUE |
| Clostridium_bolteae | clade_408 | clade_252 | clade_537 | hetero | ++++ | TRUE | TRUE |
| Clostridium_bolteae | clade_408 | clade_252 | clade_309 | hetero | ++++ | TRUE | TRUE |
| Clostridium_bolteae | clade_408 | clade_260 | clade_260 | semi | ---- | FALSE | FALSE |
| Clostridium_bolteae | clade_408 | clade_260 | clade_494 | hetero | ---- | FALSE | FALSE |
| Clostridium_bolteae | clade_408 | clade_260 | clade_360 | hetero | ++++ | FALSE | FALSE |
| Clostridium_bolteae | clade_408 | clade_260 | clade_537 | hetero | +++ | FALSE | FALSE |
| Clostridium_bolteae | clade_408 | clade_260 | clade_309 | hetero | ++++ | FALSE | TRUE |
| Clostridium_bolteae | clade_408 | clade_494 | clade_494 | semi | ---- | FALSE | FALSE |
| Clostridium_bolteae | clade_408 | clade_494 | clade_360 | hetero | ++++ | FALSE | FALSE |
| Clostridium_bolteae | clade_408 | clade_494 | clade_537 | hetero | ++++ | FALSE | FALSE |
| Clostridium_bolteae | clade_408 | clade_494 | clade_309 | hetero | ++++ | FALSE | FALSE |
| Clostridium_bolteae | clade_408 | clade_360 | clade_360 | semi | ++++ | FALSE | FALSE |
| Clostridium_bolteae | clade_408 | clade_360 | clade_537 | hetero | ++++ | FALSE | TRUE |
| Clostridium_bolteae | clade_408 | clade_360 | clade_309 | hetero | ++++ | FALSE | FALSE |
| Clostridium_symbiosum | clade_408 | clade_252 | clade_252 | semi | ++++ | FALSE | TRUE |
| Clostridium_symbiosum | clade_408 | clade_252 | clade_253 | hetero | ++++ | FALSE | TRUE |
| Clostridium_symbiosum | clade_408 | clade_252 | clade_351 | hetero | ++++ | FALSE | TRUE |
| Clostridium_symbiosum | clade_408 | clade_252 | clade_354 | hetero | ++++ | FALSE | TRUE |
| Clostridium_symbiosum | clade_408 | clade_252 | clade_252 | hetero | ++++ | TRUE | TRUE |
| Clostridium_symbiosum | clade_408 | clade_252 | clade_257 | hetero | ++++ | FALSE | TRUE |
| Clostridium_symbiosum | clade_408 | clade_252 | clade_260 | hetero | ++++ | FALSE | TRUE |
| Clostridium_symbiosum | clade_408 | clade_252 | clade_494 | hetero | ++++ | FALSE | TRUE |
| Clostridium_symbiosum | clade_408 | clade_252 | clade_537 | hetero | ++++ | FALSE | TRUE |
| Clostridium_symbiosum | clade_408 | clade_252 | clade_309 | hetero | ++++ | FALSE | FALSE |
| Clostridium_symbiosum | clade_408 | clade_253 | clade_253 | semi | ---- | FALSE | TRUE |
| Clostridium_symbiosum | clade_408 | clade_253 | clade_351 | hetero | ++++ | FALSE | FALSE |
| Clostridium_symbiosum | clade_408 | clade_253 | clade_354 | hetero | ++++ | TRUE | TRUE |
| Clostridium_symbiosum | clade_408 | clade_253 | clade_252 | hetero | , | FALSE | FALSE |
| Clostridium_symbiosum | clade_408 | clade_253 | clade_260 | hetero | ++ | FALSE | FALSE |
| Clostridium_symbiosum | clade_408 | clade_253 | clade_494 | hetero | --- | FALSE | FALSE |
| Clostridium_symbiosum | clade_408 | clade_253 | clade_360 | hetero | --- | FALSE | FALSE |
| Clostridium_symbiosum | clade_408 | clade_253 | clade_537 | hetero | ++++ | FALSE | FALSE |
| Clostridium_symbiosum | clade_408 | clade_253 | clade_309 | hetero | --- | TRUE | TRUE |
| Clostridium_symbiosum | clade_408 | clade_351 | clade_351 | semi | ++++ | TRUE | TRUE |
| Clostridium_symbiosum | clade_408 | clade_351 | clade_354 | hetero | ++++ | TRUE | FALSE |
| Clostridium_symbiosum | clade_408 | clade_351 | clade_252 | hetero | +++ | FALSE | FALSE |
| Clostridium_symbiosum | clade_408 | clade_351 | clade_260 | hetero | +++ | TRUE | TRUE |
| Clostridium_symbiosum | clade_408 | clade_351 | clade_494 | hetero | +++ | FALSE | FALSE |
| Clostridium_symbiosum | clade_408 | clade_351 | clade_360 | hetero | +++ | FALSE | FALSE |

TABLE 4a-continued

| | | | | | |
|---|---|---|---|---|---|
| Clostridium_symbiosum | clade_408 | clade_351 | clade_537 | hetero | +++ | FALSE | FALSE |
| Clostridium_symbiosum | clade_408 | clade_351 | clade_309 | hetero | ++++ | FALSE | FALSE |
| Clostridium_symbiosum | clade_408 | clade_354 | clade_354 | semi | ++++ | TRUE | FALSE |
| Clostridium_symbiosum | clade_408 | clade_354 | clade_252 | hetero | ++++ | TRUE | TRUE |
| Clostridium_symbiosum | clade_408 | clade_354 | clade_260 | hetero | ++++ | TRUE | TRUE |
| Clostridium_symbiosum | clade_408 | clade_354 | clade_494 | hetero | ++++ | FALSE | TRUE |
| Clostridium_symbiosum | clade_408 | clade_354 | clade_360 | hetero | ++++ | TRUE | TRUE |
| Clostridium_symbiosum | clade_408 | clade_354 | clade_537 | hetero | ++++ | TRUE | TRUE |
| Clostridium_symbiosum | clade_408 | clade_354 | clade_309 | hetero | ++++ | TRUE | TRUE |
| Clostridium_symbiosum | clade_408 | clade_252 | clade_252 | semi | ++++ | TRUE | FALSE |
| Clostridium_symbiosum | clade_408 | clade_252 | clade_260 | hetero | ++++ | TRUE | TRUE |
| Clostridium_symbiosum | clade_408 | clade_252 | clade_494 | hetero | ++++ | TRUE | TRUE |
| Clostridium_symbiosum | clade_408 | clade_252 | clade_360 | hetero | ++++ | TRUE | TRUE |
| Clostridium_symbiosum | clade_408 | clade_252 | clade_537 | hetero | ++++ | TRUE | TRUE |
| Clostridium_symbiosum | clade_408 | clade_252 | clade_309 | hetero | ++++ | TRUE | TRUE |
| Clostridium_symbiosum | clade_408 | clade_260 | clade_260 | semi | --- | FALSE | FALSE |
| Clostridium_symbiosum | clade_408 | clade_260 | clade_494 | hetero | ++ | FALSE | FALSE |
| Clostridium_symbiosum | clade_408 | clade_260 | clade_360 | hetero | +++ | FALSE | FALSE |
| Clostridium_symbiosum | clade_408 | clade_260 | clade_537 | hetero | ++++ | FALSE | TRUE |
| Clostridium_symbiosum | clade_408 | clade_260 | clade_309 | hetero | --- | FALSE | FALSE |
| Clostridium_symbiosum | clade_408 | clade_494 | clade_494 | semi | ++++ | FALSE | TRUE |
| Clostridium_symbiosum | clade_408 | clade_494 | clade_360 | hetero | ++++ | FALSE | TRUE |
| Clostridium_symbiosum | clade_408 | clade_494 | clade_537 | hetero | ++++ | FALSE | FALSE |
| Clostridium_symbiosum | clade_408 | clade_494 | clade_309 | hetero | ++++ | FALSE | FALSE |
| Clostridium_symbiosum | clade_408 | clade_360 | clade_360 | semi | ++++ | FALSE | FALSE |
| Clostridium_symbiosum | clade_408 | clade_360 | clade_537 | hetero | ++++ | FALSE | FALSE |
| Clostridium_symbiosum | clade_408 | clade_360 | clade_309 | hetero | ++++ | FALSE | FALSE |
| Faecalibacterium_prausnitzii | clade_478 | clade_252 | clade_257 | semi | +++ | FALSE | FALSE |
| Faecalibacterium_prausnitzii | clade_478 | clade_252 | clade_253 | hetero | ++++ | FALSE | FALSE |
| Faecalibacterium_prausnitzii | clade_478 | clade_252 | clade_351 | hetero | ++++ | FALSE | FALSE |
| Faecalibacterium_prausnitzii | clade_478 | clade_252 | clade_354 | hetero | ++++ | FALSE | FALSE |
| Faecalibacterium_prausnitzii | clade_478 | clade_252 | clade_252 | hetero | ++++ | FALSE | TRUE |
| Faecalibacterium_prausnitzii | clade_478 | clade_252 | clade_260 | hetero | ++++ | TRUE | TRUE |
| Faecalibacterium_prausnitzii | clade_478 | clade_252 | clade_494 | hetero | ++++ | FALSE | TRUE |
| Faecalibacterium_prausnitzii | clade_478 | clade_252 | clade_360 | hetero | ++++ | FALSE | TRUE |
| Faecalibacterium_prausnitzii | clade_478 | clade_252 | clade_537 | hetero | --- | FALSE | FALSE |
| Faecalibacterium_prausnitzii | clade_478 | clade_252 | clade_309 | hetero | ++++ | FALSE | FALSE |
| Faecalibacterium_prausnitzii | clade_478 | clade_253 | clade_253 | semi | --- | FALSE | FALSE |
| Faecalibacterium_prausnitzii | clade_478 | clade_253 | clade_351 | hetero | ++++ | FALSE | FALSE |
| Faecalibacterium_prausnitzii | clade_478 | clade_253 | clade_354 | hetero | --- | FALSE | FALSE |
| Faecalibacterium_prausnitzii | clade_478 | clade_253 | clade_252 | hetero | ++++ | FALSE | FALSE |
| Faecalibacterium_prausnitzii | clade_478 | clade_253 | clade_260 | hetero | --- | FALSE | FALSE |
| Faecalibacterium_prausnitzii | clade_478 | clade_253 | clade_494 | hetero | --- | FALSE | FALSE |
| Faecalibacterium_prausnitzii | clade_478 | clade_253 | clade_360 | hetero | -, | FALSE | FALSE |
| Faecalibacterium_prausnitzii | clade_478 | clade_253 | clade_537 | hetero | --- | FALSE | FALSE |
| Faecalibacterium_prausnitzii | clade_478 | clade_253 | clade_309 | hetero | ++++ | FALSE | FALSE |
| Faecalibacterium_prausnitzii | clade_478 | clade_351 | clade_351 | semi | --- | TRUE | TRUE |
| Faecalibacterium_prausnitzii | clade_478 | clade_351 | clade_354 | hetero | ++++ | FALSE | FALSE |
| Faecalibacterium_prausnitzii | clade_478 | clade_351 | clade_252 | hetero | ++++ | FALSE | FALSE |
| Faecalibacterium_prausnitzii | clade_478 | clade_351 | clade_260 | hetero | --- | FALSE | FALSE |
| Faecalibacterium_prausnitzii | clade_478 | clade_351 | clade_494 | hetero | , | FALSE | FALSE |
| Faecalibacterium_prausnitzii | clade_478 | clade_351 | clade_360 | hetero | --- | FALSE | FALSE |
| Faecalibacterium_prausnitzii | clade_478 | clade_351 | clade_537 | hetero | --- | FALSE | FALSE |

TABLE 4a-continued

| Species | Col2 | Col3 | Col4 | Col5 | Col6 | Col7 | Col8 |
|---|---|---|---|---|---|---|---|
| Faecalibacterium_prausnitzii | clade_478 | clade_351 | clade_309 | hetero | ++++ | FALSE | FALSE |
| Faecalibacterium_prausnitzii | clade_478 | clade_354 | clade_354 | semi | ++++ | FALSE | FALSE |
| Faecalibacterium_prausnitzii | clade_478 | clade_354 | clade_252 | hetero | ++++ | TRUE | TRUE |
| Faecalibacterium_prausnitzii | clade_478 | clade_354 | clade_260 | hetero | ++++ | FALSE | TRUE |
| Faecalibacterium_prausnitzii | clade_478 | clade_354 | clade_494 | hetero | ++++ | FALSE | TRUE |
| Faecalibacterium_prausnitzii | clade_478 | clade_354 | clade_360 | hetero | ++++ | FALSE | TRUE |
| Faecalibacterium_prausnitzii | clade_478 | clade_354 | clade_537 | hetero | ++++ | TRUE | TRUE |
| Faecalibacterium_prausnitzii | clade_478 | clade_354 | clade_309 | hetero | ++++ | TRUE | FALSE |
| Faecalibacterium_prausnitzii | clade_478 | clade_252 | clade_252 | semi | ++++ | TRUE | TRUE |
| Faecalibacterium_prausnitzii | clade_478 | clade_252 | clade_260 | hetero | ++++ | TRUE | TRUE |
| Faecalibacterium_prausnitzii | clade_478 | clade_252 | clade_494 | hetero | ++++ | TRUE | TRUE |
| Faecalibacterium_prausnitzii | clade_478 | clade_252 | clade_360 | hetero | ++++ | TRUE | TRUE |
| Faecalibacterium_prausnitzii | clade_478 | clade_252 | clade_537 | hetero | ++++ | TRUE | TRUE |
| Faecalibacterium_prausnitzii | clade_478 | clade_252 | clade_309 | hetero | ++++ | TRUE | TRUE |
| Faecalibacterium_prausnitzii | clade_478 | clade_260 | clade_260 | semi | ---- | FALSE | FALSE |
| Faecalibacterium_prausnitzii | clade_478 | clade_260 | clade_494 | hetero | ---- | FALSE | FALSE |
| Faecalibacterium_prausnitzii | clade_478 | clade_260 | clade_360 | hetero | ++++ | FALSE | TRUE |
| Faecalibacterium_prausnitzii | clade_478 | clade_260 | clade_537 | hetero | --- | FALSE | FALSE |
| Faecalibacterium_prausnitzii | clade_478 | clade_260 | clade_309 | hetero | ++++ | FALSE | FALSE |
| Faecalibacterium_prausnitzii | clade_478 | clade_494 | clade_494 | semi | ---- | FALSE | FALSE |
| Faecalibacterium_prausnitzii | clade_478 | clade_494 | clade_360 | hetero | ++++ | FALSE | FALSE |
| Faecalibacterium_prausnitzii | clade_478 | clade_494 | clade_537 | hetero | -- | FALSE | FALSE |
| Faecalibacterium_prausnitzii | clade_478 | clade_494 | clade_309 | hetero | ++++ | FALSE | FALSE |
| Faecalibacterium_prausnitzii | clade_478 | clade_360 | clade_360 | semi | ++++ | FALSE | FALSE |
| Faecalibacterium_prausnitzii | clade_478 | clade_360 | clade_537 | hetero | ++++ | FALSE | TRUE |
| Lachnospiraceae_bacterium_5_1_57FAA | clade_260 | clade_252 | clade_252 | semi | ++++ | FALSE | FALSE |
| Lachnospiraceae_bacterium_5_1_57FAA | clade_260 | clade_252 | clade_253 | hetero | ++++ | FALSE | TRUE |
| Lachnospiraceae_bacterium_5_1_57FAA | clade_260 | clade_252 | clade_351 | hetero | ++++ | FALSE | FALSE |
| Lachnospiraceae_bacterium_5_1_57FAA | clade_260 | clade_252 | clade_354 | hetero | ++++ | FALSE | FALSE |
| Lachnospiraceae_bacterium_5_1_57FAA | clade_260 | clade_252 | clade_252 | hetero | ---- | FALSE | FALSE |
| Lachnospiraceae_bacterium_5_1_57FAA | clade_260 | clade_252 | clade_260 | hetero | ++++ | FALSE | TRUE |
| Lachnospiraceae_bacterium_5_1_57FAA | clade_260 | clade_252 | clade_494 | hetero | ---- | TRUE | TRUE |
| Lachnospiraceae_bacterium_5_1_57FAA | clade_260 | clade_252 | clade_360 | hetero | ++++ | FALSE | FALSE |
| Lachnospiraceae_bacterium_5_1_57FAA | clade_260 | clade_252 | clade_537 | hetero | ++++ | FALSE | TRUE |
| Lachnospiraceae_bacterium_5_1_57FAA | clade_260 | clade_252 | clade_309 | hetero | ++++ | FALSE | TRUE |
| Lachnospiraceae_bacterium_5_1_57FAA | clade_260 | clade_253 | clade_253 | semi | ---- | FALSE | FALSE |
| Lachnospiraceae_bacterium_5_1_57FAA | clade_260 | clade_253 | clade_351 | hetero | +++ | FALSE | FALSE |
| Lachnospiraceae_bacterium_5_1_57FAA | clade_260 | clade_253 | clade_354 | hetero | ---- | FALSE | FALSE |
| Lachnospiraceae_bacterium_5_1_57FAA | clade_260 | clade_253 | clade_252 | semi | ---- | FALSE | FALSE |
| Lachnospiraceae_bacterium_5_1_57FAA | clade_260 | clade_253 | clade_253 | hetero | ++++ | FALSE | FALSE |
| Lachnospiraceae_bacterium_5_1_57FAA | clade_260 | clade_351 | clade_351 | hetero | ++++ | TRUE | TRUE |
| Lachnospiraceae_bacterium_5_1_57FAA | clade_260 | clade_351 | clade_354 | hetero | ++++ | FALSE | FALSE |
| Lachnospiraceae_bacterium_5_1_57FAA | clade_260 | clade_351 | clade_252 | hetero | ---- | FALSE | FALSE |
| Lachnospiraceae_bacterium_5_1_57FAA | clade_260 | clade_351 | clade_260 | hetero | ++++ | FALSE | FALSE |
| Lachnospiraceae_bacterium_5_1_57FAA | clade_260 | clade_351 | clade_494 | hetero | ++++ | FALSE | FALSE |
| Lachnospiraceae_bacterium_5_1_57FAA | clade_260 | clade_351 | clade_360 | hetero | ++++ | FALSE | FALSE |
| Lachnospiraceae_bacterium_5_1_57FAA | clade_260 | clade_351 | clade_537 | hetero | ++++ | FALSE | FALSE |
| Lachnospiraceae_bacterium_5_1_57FAA | clade_260 | clade_351 | clade_309 | hetero | ++++ | FALSE | FALSE |

TABLE 4a-continued

| Species | col2 | col3 | col4 | type | marks | v1 | v2 | v3 |
|---|---|---|---|---|---|---|---|---|
| Lachnospiraceae_bacterium_5_1_57FAA | clade_260 | clade_260 | clade_354 | semi | ++++ | FALSE | FALSE | |
| Lachnospiraceae_bacterium_5_1_57FAA | clade_260 | clade_260 | clade_354 | hetero | ++++ | TRUE | FALSE | |
| Lachnospiraceae_bacterium_5_1_57FAA | clade_260 | clade_260 | clade_354 | hetero | ++++ | FALSE | TRUE | |
| Lachnospiraceae_bacterium_5_1_57FAA | clade_260 | clade_260 | clade_354 | hetero | ++++ | TRUE | TRUE | |
| Lachnospiraceae_bacterium_5_1_57FAA | clade_260 | clade_260 | clade_354 | hetero | ++++ | TRUE | TRUE | |
| Lachnospiraceae_bacterium_5_1_57FAA | clade_260 | clade_260 | clade_537 | hetero | ++++ | TRUE | TRUE | |
| Lachnospiraceae_bacterium_5_1_57FAA | clade_260 | clade_260 | clade_309 | hetero | ++++ | TRUE | TRUE | |
| Lachnospiraceae_bacterium_5_1_57FAA | clade_260 | clade_260 | clade_252 | semi | ++++ | TRUE | FALSE | |
| Lachnospiraceae_bacterium_5_1_57FAA | clade_260 | clade_260 | clade_260 | hetero | ++++ | TRUE | TRUE | |
| Lachnospiraceae_bacterium_5_1_57FAA | clade_260 | clade_260 | clade_494 | hetero | ++++ | TRUE | TRUE | |
| Lachnospiraceae_bacterium_5_1_57FAA | clade_260 | clade_260 | clade_360 | hetero | ++++ | TRUE | TRUE | |
| Lachnospiraceae_bacterium_5_1_57FAA | clade_260 | clade_260 | clade_537 | hetero | ++++ | TRUE | TRUE | |
| Lachnospiraceae_bacterium_5_1_57FAA | clade_260 | clade_260 | clade_309 | hetero | ++++ | TRUE | TRUE | |
| Lachnospiraceae_bacterium_5_1_57FAA | clade_260 | clade_252 | clade_252 | semi | ---- | FALSE | FALSE | |
| Lachnospiraceae_bacterium_5_1_57FAA | clade_260 | clade_260 | clade_494 | hetero | ---- | FALSE | FALSE | |
| Lachnospiraceae_bacterium_5_1_57FAA | clade_260 | clade_260 | clade_494 | hetero | +++ | FALSE | FALSE | |
| Lachnospiraceae_bacterium_5_1_57FAA | clade_260 | clade_260 | clade_537 | hetero | ++++ | FALSE | TRUE | |
| Lachnospiraceae_bacterium_5_1_57FAA | clade_260 | clade_260 | clade_309 | semi | ++++ | FALSE | FALSE | |
| Lachnospiraceae_bacterium_5_1_57FAA | clade_260 | clade_260 | clade_494 | hetero | +++ | FALSE | FALSE | |
| Lachnospiraceae_bacterium_5_1_57FAA | clade_260 | clade_260 | clade_360 | hetero | ++++ | FALSE | FALSE | |
| Lachnospiraceae_bacterium_5_1_57FAA | clade_260 | clade_260 | clade_537 | hetero | ++++ | FALSE | FALSE | |
| Lachnospiraceae_bacterium_5_1_57FAA | clade_260 | clade_260 | clade_309 | semi | ++++ | FALSE | FALSE | |
| Lachnospiraceae_bacterium_5_1_57FAA | clade_260 | clade_260 | clade_360 | hetero | ++++ | FALSE | FALSE | |
| Lachnospiraceae_bacterium_5_1_57FAA | clade_260 | clade_260 | clade_537 | semi | ++++ | FALSE | FALSE | |
| Lachnospiraceae_bacterium_5_1_57FAA | clade_260 | clade_260 | clade_309 | hetero | ++++ | FALSE | TRUE | |
| Blautia_producta | clade_309 | clade_309 | clade_309 | hetero | ++++ | TRUE | TRUE | FALSE |
| Blautia_producta | clade_309 | clade_252 | clade_252 | semi | ++++ | TRUE | TRUE | FALSE |
| Blautia_producta | clade_309 | clade_252 | clade_252 | hetero | ++++ | TRUE | TRUE | FALSE |
| Blautia_producta | clade_309 | clade_252 | clade_351 | hetero | ++++ | TRUE | TRUE | FALSE |
| Blautia_producta | clade_309 | clade_252 | clade_354 | hetero | ++++ | TRUE | TRUE | TRUE |
| Blautia_producta | clade_309 | clade_252 | clade_252 | hetero | +++ | TRUE | TRUE | FALSE |
| Blautia_producta | clade_309 | clade_252 | clade_260 | hetero | ++++ | FALSE | TRUE | FALSE |
| Blautia_producta | clade_309 | clade_252 | clade_494 | hetero | ++++ | TRUE | TRUE | FALSE |
| Blautia_producta | clade_309 | clade_252 | clade_360 | hetero | ++++ | TRUE | TRUE | FALSE |
| Blautia_producta | clade_309 | clade_252 | clade_537 | hetero | ++++ | TRUE | TRUE | FALSE |
| Blautia_producta | clade_309 | clade_252 | clade_309 | hetero | ++++ | TRUE | TRUE | FALSE |
| Blautia_producta | clade_309 | clade_253 | clade_253 | semi | ++++ | FALSE | TRUE | FALSE |
| Blautia_producta | clade_309 | clade_253 | clade_351 | hetero | ++++ | FALSE | TRUE | FALSE |
| Blautia_producta | clade_309 | clade_253 | clade_354 | hetero | ++++ | TRUE | TRUE | TRUE |
| Blautia_producta | clade_309 | clade_253 | clade_252 | hetero | ++++ | TRUE | TRUE | FALSE |
| Blautia_producta | clade_309 | clade_253 | clade_260 | hetero | ++++ | TRUE | TRUE | FALSE |
| Blautia_producta | clade_309 | clade_253 | clade_494 | hetero | ++++ | TRUE | TRUE | FALSE |
| Blautia_producta | clade_309 | clade_253 | clade_360 | hetero | ++++ | TRUE | TRUE | FALSE |
| Blautia_producta | clade_309 | clade_253 | clade_537 | hetero | ++++ | TRUE | TRUE | FALSE |
| Blautia_producta | clade_309 | clade_253 | clade_309 | hetero | ++++ | TRUE | | FALSE |
| Blautia_producta | clade_309 | clade_351 | clade_351 | semi | ++++ | TRUE | TRUE | FALSE |
| Blautia_producta | clade_309 | clade_351 | clade_354 | hetero | ++++ | TRUE | TRUE | TRUE |
| Blautia_producta | clade_309 | clade_351 | clade_252 | hetero | ++++ | TRUE | TRUE | FALSE |
| Blautia_producta | clade_309 | clade_351 | clade_260 | hetero | ++++ | TRUE | TRUE | FALSE |
| Blautia_producta | clade_309 | clade_351 | clade_494 | hetero | ++++ | TRUE | TRUE | FALSE |
| Blautia_producta | clade_309 | clade_351 | clade_360 | hetero | ++++ | TRUE | TRUE | FALSE |
| Blautia_producta | clade_309 | clade_351 | clade_537 | hetero | ++++ | TRUE | TRUE | FALSE |
| Blautia_producta | clade_309 | clade_351 | clade_309 | hetero | ++++ | TRUE | TRUE | FALSE |
| Blautia_producta | clade_309 | clade_354 | clade_354 | semi | ++++ | TRUE | TRUE | TRUE |

TABLE 4a-continued

| | | | | | | |
|---|---|---|---|---|---|---|
| Blautia_producta | clade_309 | clade_354 | clade_252 | hetero | ++++ | TRUE | FALSE | TRUE |
| Blautia_producta | clade_309 | clade_354 | clade_260 | hetero | ++++ | TRUE | TRUE | FALSE |
| Blautia_producta | clade_309 | clade_354 | clade_494 | hetero | ++++ | TRUE | TRUE | FALSE |
| Blautia_producta | clade_309 | clade_354 | clade_360 | hetero | ++++ | TRUE | TRUE | FALSE |
| Blautia_producta | clade_309 | clade_354 | clade_537 | hetero | ++++ | TRUE | TRUE | TRUE |
| Blautia_producta | clade_309 | clade_354 | clade_309 | semi   | ++++ | TRUE | FALSE | TRUE |
| Blautia_producta | clade_309 | clade_252 | clade_252 | hetero | ++++ | TRUE | TRUE | TRUE |
| Blautia_producta | clade_309 | clade_252 | clade_260 | hetero | ++++ | TRUE | TRUE | TRUE |
| Blautia_producta | clade_309 | clade_252 | clade_494 | hetero | ++++ | TRUE | TRUE | TRUE |
| Blautia_producta | clade_309 | clade_252 | clade_360 | hetero | ++++ | TRUE | TRUE | TRUE |
| Blautia_producta | clade_309 | clade_252 | clade_537 | hetero | ++++ | TRUE | TRUE | TRUE |
| Blautia_producta | clade_309 | clade_252 | clade_309 | semi   | ++++ | TRUE | TRUE | FALSE |
| Blautia_producta | clade_309 | clade_260 | clade_260 | hetero | ++++ | TRUE | TRUE | FALSE |
| Blautia_producta | clade_309 | clade_260 | clade_494 | hetero | ++++ | TRUE | TRUE | FALSE |
| Blautia_producta | clade_309 | clade_260 | clade_360 | hetero | ++++ | TRUE | TRUE | FALSE |
| Blautia_producta | clade_309 | clade_260 | clade_537 | hetero | ++++ | TRUE | TRUE | FALSE |
| Blautia_producta | clade_309 | clade_260 | clade_309 | semi   | ++++ | TRUE | TRUE | FALSE |
| Blautia_producta | clade_309 | clade_494 | clade_494 | hetero | ++++ | TRUE | TRUE | TRUE |
| Blautia_producta | clade_309 | clade_494 | clade_360 | hetero | ++++ | TRUE | TRUE | FALSE |
| Blautia_producta | clade_309 | clade_494 | clade_537 | hetero | ++++ | TRUE | TRUE | FALSE |
| Blautia_producta | clade_309 | clade_494 | clade_309 | hetero | ++++ | TRUE | TRUE | FALSE |
| Blautia_producta | clade_309 | clade_360 | clade_360 | semi   | ++++ | TRUE | TRUE | TRUE |
| Blautia_producta | clade_309 | clade_360 | clade_537 | hetero | ++++ | TRUE | TRUE | FALSE |
| Blautia_producta | clade_309 | clade_360 | clade_309 | hetero | ++++ | TRUE |  |  |
| Eubacterium_rectale | clade_444 | clade_252 | clade_252 | semi   | +++  | FALSE | FALSE | |
| Eubacterium_rectale | clade_444 | clade_252 | clade_253 | hetero | ---- | FALSE | FALSE | |
| Eubacterium_rectale | clade_444 | clade_252 | clade_351 | hetero | ++++ | FALSE | FALSE | |
| Eubacterium_rectale | clade_444 | clade_252 | clade_354 | hetero | ++++ | TRUE  | TRUE  | |
| Eubacterium_rectale | clade_444 | clade_252 | clade_252 | hetero | ++++ | FALSE | TRUE  | |
| Eubacterium_rectale | clade_444 | clade_252 | clade_260 | hetero | ---- | FALSE | FALSE | |
| Eubacterium_rectale | clade_444 | clade_252 | clade_494 | hetero | ---- | FALSE | FALSE | |
| Eubacterium_rectale | clade_444 | clade_252 | clade_360 | hetero | ---- | FALSE | FALSE | |
| Eubacterium_rectale | clade_444 | clade_252 | clade_537 | hetero | ++++ | FALSE | FALSE | |
| Eubacterium_rectale | clade_444 | clade_252 | clade_309 | hetero | ++++ | FALSE | FALSE | |
| Eubacterium_rectale | clade_444 | clade_253 | clade_253 | semi   | ---- | FALSE | FALSE | |
| Eubacterium_rectale | clade_444 | clade_253 | clade_351 | hetero | ++++ | TRUE  | TRUE  | |
| Eubacterium_rectale | clade_444 | clade_253 | clade_354 | hetero | ++++ | TRUE  | FALSE | |
| Eubacterium_rectale | clade_444 | clade_253 | clade_252 | hetero | ---- | FALSE | FALSE | |
| Eubacterium_rectale | clade_444 | clade_253 | clade_260 | hetero | ---- | FALSE | FALSE | |
| Eubacterium_rectale | clade_444 | clade_253 | clade_494 | hetero | ---- | FALSE | FALSE | |
| Eubacterium_rectale | clade_444 | clade_253 | clade_360 | hetero | ---- | FALSE | FALSE | |
| Eubacterium_rectale | clade_444 | clade_253 | clade_537 | hetero | ++++ | FALSE | FALSE | |
| Eubacterium_rectale | clade_444 | clade_253 | clade_309 | hetero | ++++ | FALSE | FALSE | |
| Eubacterium_rectale | clade_444 | clade_351 | clade_351 | semi   | ++++ | FALSE | FALSE | |
| Eubacterium_rectale | clade_444 | clade_351 | clade_354 | hetero | ++++ | TRUE  | TRUE  | |
| Eubacterium_rectale | clade_444 | clade_351 | clade_252 | hetero | ---- | TRUE  | FALSE | |
| Eubacterium_rectale | clade_444 | clade_351 | clade_260 | hetero | ++++ | FALSE | FALSE | |
| Eubacterium_rectale | clade_444 | clade_351 | clade_494 | hetero | ---- | FALSE | FALSE | |
| Eubacterium_rectale | clade_444 | clade_351 | clade_360 | hetero | ---- | FALSE | FALSE | |
| Eubacterium_rectale | clade_444 | clade_351 | clade_537 | hetero | ++++ | FALSE | FALSE | |
| Eubacterium_rectale | clade_444 | clade_354 | clade_309 | hetero | ++++ | FALSE | FALSE | |
| Eubacterium_rectale | clade_444 | clade_354 | clade_354 | semi   | ++++ | FALSE | FALSE | |
| Eubacterium_rectale | clade_444 | clade_354 | clade_252 | hetero | ++++ | TRUE  | FALSE | |

TABLE 4a-continued

| | | | | | | | |
|---|---|---|---|---|---|---|---|
| Eubacterium_rectale | clade_444 | clade_354 | clade_260 | hetero | ++++ | TRUE | TRUE |
| Eubacterium_rectale | clade_444 | clade_354 | clade_494 | hetero | ++++ | TRUE | TRUE |
| Eubacterium_rectale | clade_444 | clade_354 | clade_360 | hetero | ++++ | TRUE | TRUE |
| Eubacterium_rectale | clade_444 | clade_354 | clade_537 | hetero | ++++ | TRUE | TRUE |
| Eubacterium_rectale | clade_444 | clade_354 | clade_309 | semi | ++++ | TRUE | FALSE |
| Eubacterium_rectale | clade_444 | clade_252 | clade_252 | hetero | ++++ | TRUE | TRUE |
| Eubacterium_rectale | clade_444 | clade_252 | clade_260 | hetero | ++++ | TRUE | TRUE |
| Eubacterium_rectale | clade_444 | clade_252 | clade_494 | hetero | ++++ | TRUE | TRUE |
| Eubacterium_rectale | clade_444 | clade_252 | clade_360 | hetero | ++++ | TRUE | TRUE |
| Eubacterium_rectale | clade_444 | clade_252 | clade_537 | hetero | ++++ | TRUE | TRUE |
| Eubacterium_rectale | clade_444 | clade_252 | clade_309 | hetero | ++++ | TRUE | TRUE |
| Eubacterium_rectale | clade_444 | clade_260 | clade_260 | semi | ++++ | FALSE | FALSE |
| Eubacterium_rectale | clade_444 | clade_260 | clade_494 | hetero | — — — | FALSE | FALSE |
| Eubacterium_rectale | clade_444 | clade_260 | clade_360 | hetero | + | FALSE | TRUE |
| Eubacterium_rectale | clade_444 | clade_260 | clade_537 | hetero | — | FALSE | TRUE |
| Eubacterium_rectale | clade_444 | clade_494 | clade_309 | hetero | ++++ | FALSE | FALSE |
| Eubacterium_rectale | clade_444 | clade_494 | clade_494 | semi | — | FALSE | FALSE |
| Eubacterium_rectale | clade_444 | clade_494 | clade_360 | hetero | ++++ | FALSE | FALSE |
| Eubacterium_rectale | clade_444 | clade_494 | clade_537 | hetero | — | FALSE | FALSE |
| Eubacterium_rectale | clade_444 | clade_494 | clade_309 | hetero | ++++ | FALSE | FALSE |
| Eubacterium_rectale | clade_444 | clade_360 | clade_360 | semi | ++++ | FALSE | FALSE |
| Eubacterium_rectale | clade_444 | clade_360 | clade_537 | hetero | ++++ | FALSE | TRUE |
| Clostridium_tertium | clade_252 | clade_553 | clade_553 | semi | ++++ | FALSE | FALSE |
| Clostridium_tertium | clade_252 | clade_553 | clade_262 | hetero | ++++ | FALSE | FALSE |
| Clostridium_tertium | clade_252 | clade_553 | clade_408 | hetero | ++++ | FALSE | FALSE |
| Clostridium_tertium | clade_252 | clade_553 | clade_408 | hetero | ++++ | FALSE | FALSE |
| Clostridium_tertium | clade_252 | clade_553 | clade_478 | hetero | ++++ | FALSE | FALSE |
| Clostridium_tertium | clade_252 | clade_553 | clade_260 | hetero | +++ | FALSE | FALSE |
| Clostridium_tertium | clade_252 | clade_553 | clade_309 | hetero | ++++ | FALSE | FALSE |
| Clostridium_tertium | clade_252 | clade_262 | clade_444 | hetero | ++++ | TRUE | TRUE |
| Clostridium_tertium | clade_252 | clade_262 | clade_408 | hetero | ++++ | FALSE | FALSE |
| Clostridium_tertium | clade_252 | clade_262 | clade_408 | semi | ++++ | FALSE | FALSE |
| Clostridium_tertium | clade_252 | clade_262 | clade_478 | hetero | +++ | FALSE | FALSE |
| Clostridium_tertium | clade_252 | clade_262 | clade_260 | semi | — — | FALSE | FALSE |
| Clostridium_tertium | clade_252 | clade_262 | clade_309 | hetero | ++++ | FALSE | FALSE |
| Clostridium_tertium | clade_252 | clade_408 | clade_408 | hetero | — | FALSE | FALSE |
| Clostridium_tertium | clade_252 | clade_408 | clade_478 | hetero | ++++ | FALSE | TRUE |
| Clostridium_tertium | clade_252 | clade_408 | clade_260 | hetero | +++ | FALSE | FALSE |
| Clostridium_tertium | clade_252 | clade_408 | clade_309 | semi | — — | FALSE | TRUE |
| Clostridium_tertium | clade_252 | clade_408 | clade_444 | hetero | ++++ | FALSE | FALSE |
| Clostridium_tertium | clade_252 | clade_478 | clade_478 | semi | ++++ | FALSE | FALSE |
| Clostridium_tertium | clade_252 | clade_478 | clade_260 | hetero | ++++ | FALSE | TRUE |
| Clostridium_tertium | clade_252 | clade_478 | clade_309 | hetero | ++++ | FALSE | FALSE |
| Clostridium_tertium | clade_252 | clade_478 | clade_444 | hetero | ++++ | FALSE | FALSE |

TABLE 4a-continued

| Species | Col2 | Col3 | Col4 | Type | Signal | Col7 | Col8 |
|---|---|---|---|---|---|---|---|
| Clostridium_tertium | clade_252 | clade_252 | clade_260 | semi | ++++ | FALSE | FALSE |
| Clostridium_tertium | clade_252 | clade_252 | clade_260 | hetero | ++++ | FALSE | TRUE |
| Clostridium_tertium | clade_252 | clade_252 | clade_444 | hetero | ++++ | FALSE | TRUE |
| Clostridium_tertium | clade_252 | clade_252 | clade_309 | semi | ++++ | FALSE | TRUE |
| Clostridium_tertium | clade_252 | clade_252 | clade_444 | hetero | ++++ | TRUE | TRUE |
| Clostridium_tertium | clade_252 | clade_252 | clade_444 | semi | +++ | FALSE | TRUE |
| Clostridium_dispericum | clade_252 | clade_252 | clade_553 | semi | – | FALSE | FALSE |
| Clostridium_dispericum | clade_253 | clade_553 | clade_262 | hetero | – –

TABLE 4a-continued

| | | | | | |
|---|---|---|---|---|---|
| Clostridium_innocuum | clade_351 | clade_262 | clade_478 | hetero | ---- | FALSE | FALSE |
| Clostridium_innocuum | clade_351 | clade_262 | clade_260 | hetero | ++++ | FALSE | FALSE |
| Clostridium_innocuum | clade_351 | clade_262 | clade_309 | hetero | ++++ | FALSE | TRUE |
| Clostridium_innocuum | clade_351 | clade_262 | clade_444 | semi | ++++ | FALSE | FALSE |
| Clostridium_innocuum | clade_351 | clade_408 | clade_408 | semi | ++ | FALSE | FALSE |
| Clostridium_innocuum | clade_351 | clade_408 | clade_478 | hetero | +++ | FALSE | FALSE |
| Clostridium_innocuum | clade_351 | clade_408 | clade_260 | hetero | ++++ | FALSE | FALSE |
| Clostridium_innocuum | clade_351 | clade_408 | clade_309 | hetero | ++++ | FALSE | TRUE |
| Clostridium_innocuum | clade_351 | clade_408 | clade_444 | semi | ++++ | FALSE | FALSE |
| Clostridium_innocuum | clade_351 | clade_408 | clade_408 | hetero | -- | FALSE | FALSE |
| Clostridium_innocuum | clade_351 | clade_408 | clade_260 | hetero | ++++ | FALSE | FALSE |
| Clostridium_innocuum | clade_351 | clade_408 | clade_309 | hetero | +++ | FALSE | FALSE |
| Clostridium_innocuum | clade_351 | clade_408 | clade_444 | hetero | ++++ | FALSE | FALSE |
| Clostridium_innocuum | clade_351 | clade_478 | clade_478 | semi | ++++ | FALSE | FALSE |
| Clostridium_innocuum | clade_351 | clade_478 | clade_260 | hetero | ---- | FALSE | TRUE |
| Clostridium_innocuum | clade_351 | clade_478 | clade_309 | hetero | ++++ | FALSE | TRUE |
| Clostridium_innocuum | clade_351 | clade_478 | clade_444 | hetero | ++++ | FALSE | TRUE |
| Clostridium_innocuum | clade_351 | clade_260 | clade_260 | semi | ++++ | TRUE | TRUE |
| Clostridium_innocuum | clade_351 | clade_260 | clade_309 | hetero | +++ | FALSE | TRUE |
| Clostridium_innocuum | clade_351 | clade_260 | clade_444 | hetero | ++++ | FALSE | FALSE |
| Clostridium_innocuum | clade_351 | clade_309 | clade_309 | semi | ++++ | FALSE | FALSE |
| Clostridium_innocuum | clade_351 | clade_309 | clade_444 | hetero | ++++ | FALSE | TRUE |
| Clostridium_innocuum | clade_351 | clade_444 | clade_444 | hetero | ++++ | FALSE | TRUE |
| Clostridium_mayombei | clade_354 | clade_553 | clade_553 | semi | +++ | FALSE | TRUE |
| Clostridium_mayombei | clade_354 | clade_553 | clade_262 | semi | ++++ | FALSE | FALSE |
| Clostridium_mayombei | clade_354 | clade_553 | clade_408 | hetero | ++++ | FALSE | FALSE |
| Clostridium_mayombei | clade_354 | clade_553 | clade_408 | hetero | ++++ | FALSE | FALSE |
| Clostridium_mayombei | clade_354 | clade_553 | clade_478 | hetero | ++++ | FALSE | TRUE |
| Clostridium_mayombei | clade_354 | clade_553 | clade_260 | hetero | ++++ | FALSE | TRUE |
| Clostridium_mayombei | clade_354 | clade_553 | clade_309 | hetero | ++++ | FALSE | TRUE |
| Clostridium_mayombei | clade_354 | clade_553 | clade_444 | semi | ++++ | FALSE | FALSE |
| Clostridium_mayombei | clade_354 | clade_262 | clade_262 | hetero | ++++ | FALSE | TRUE |
| Clostridium_mayombei | clade_354 | clade_262 | clade_408 | semi | ++++ | FALSE | FALSE |
| Clostridium_mayombei | clade_354 | clade_262 | clade_408 | hetero | ++++ | FALSE | TRUE |
| Clostridium_mayombei | clade_354 | clade_262 | clade_478 | hetero | ++++ | FALSE | FALSE |
| Clostridium_mayombei | clade_354 | clade_262 | clade_260 | hetero | ++++ | FALSE | FALSE |
| Clostridium_mayombei | clade_354 | clade_262 | clade_309 | semi | ++++ | TRUE | TRUE |
| Clostridium_mayombei | clade_354 | clade_262 | clade_444 | hetero | ++++ | FALSE | FALSE |
| Clostridium_mayombei | clade_354 | clade_408 | clade_408 | hetero | ++++ | FALSE | TRUE |
| Clostridium_mayombei | clade_354 | clade_408 | clade_478 | hetero | ++++ | TRUE | TRUE |
| Clostridium_mayombei | clade_354 | clade_408 | clade_260 | hetero | ++++ | FALSE | FALSE |
| Clostridium_mayombei | clade_354 | clade_408 | clade_309 | hetero | ++++ | FALSE | TRUE |
| Clostridium_mayombei | clade_354 | clade_408 | clade_444 | hetero | ++++ | FALSE | FALSE |
| Clostridium_mayombei | clade_354 | clade_408 | clade_478 | semi | ++++ | TRUE | FALSE |
| Clostridium_mayombei | clade_354 | clade_408 | clade_260 | hetero | ++++ | TRUE | TRUE |
| Clostridium_mayombei | clade_354 | clade_408 | clade_309 | hetero | ++++ | FALSE | FALSE |
| Clostridium_mayombei | clade_354 | clade_408 | clade_444 | hetero | ++++ | FALSE | FALSE |
| Clostridium_mayombei | clade_354 | clade_478 | clade_478 | semi | ++++ | TRUE | TRUE |
| Clostridium_mayombei | clade_354 | clade_478 | clade_260 | hetero | ++++ | FALSE | TRUE |

TABLE 4a-continued

| | | | | | | | |
|---|---|---|---|---|---|---|---|
| Clostridium__mayombei | clade__354 | clade__478 | clade__309 | hetero | ++++ | TRUE | TRUE |
| Closiridium__mayombei | clade__354 | clade__478 | clade__444 | hetero | ++++ | TRUE | TRUE |
| Clostridium__mayombei | clade__354 | clade__260 | clade__260 | semi | ++++ | FALSE | TRUE |
| Clostridium__mayombei | clade__354 | clade__260 | clade__309 | hetero | ++++ | TRUE | TRUE |
| Clostridium__mayombei | clade__354 | clade__260 | clade__444 | hetero | ++++ | TRUE | TRUE |
| Clostridium__mayombei | clade__354 | clade__309 | clade__309 | semi | ++++ | FALSE | FALSE |
| Clostridium__mayombei | clade__354 | clade__309 | clade__444 | hetero | ++++ | TRUE | TRUE |
| Clostridium__mayombei | clade__354 | clade__444 | clade__444 | semi | ++++ | TRUE | TRUE |
| Clostridium__butyricum | clade__252 | clade__553 | clade__553 | semi | ++++ | TRUE | TRUE |
| Clostridium__butyricum | clade__252 | clade__553 | clade__262 | hetero | ++++ | TRUE | TRUE |
| Clostridium__butyricum | clade__252 | clade__553 | clade__408 | hetero | ++++ | TRUE | FALSE |
| Clostridium__butyricum | clade__252 | clade__553 | clade__408 | hetero | ++++ | TRUE | TRUE |
| Clostridium__butyricum | clade__252 | clade__553 | clade__478 | hetero | ++++ | TRUE | TRUE |
| Clostridium__butyricum | clade__252 | clade__553 | clade__260 | hetero | ++++ | TRUE | TRUE |
| Clostridium__butyricum | clade__252 | clade__553 | clade__309 | hetero | ++++ | TRUE | TRUE |
| Clostridium__butyricum | clade__252 | clade__553 | clade__444 | hetero | ++++ | TRUE | TRUE |
| Clostridium__butyricum | clade__252 | clade__262 | clade__262 | semi | ++++ | TRUE | TRUE |
| Clostridium__butyricum | clade__252 | clade__262 | clade__408 | hetero | ++++ | TRUE | TRUE |
| Clostridium__butyricum | clade__252 | clade__262 | clade__408 | hetero | ++++ | TRUE | TRUE |
| Clostridium__butyricum | clade__252 | clade__262 | clade__478 | hetero | ++++ | TRUE | TRUE |
| Clostridium__butyricum | clade__252 | clade__262 | clade__260 | hetero | ++++ | TRUE | TRUE |
| Clostridium__butyricum | clade__252 | clade__262 | clade__309 | hetero | ++++ | TRUE | TRUE |
| Clostridium__butyricum | clade__252 | clade__262 | clade__444 | hetero | ++++ | TRUE | TRUE |
| Clostridium__butyricum | clade__252 | clade__408 | clade__408 | semi | ++++ | TRUE | TRUE |
| Clostridium__butyricum | clade__252 | clade__408 | clade__408 | hetero | ++++ | TRUE | FALSE |
| Clostridium__butyricum | clade__252 | clade__408 | clade__478 | hetero | ++++ | TRUE | TRUE |
| Clostridium__butyricum | clade__252 | clade__408 | clade__260 | hetero | ++++ | TRUE | TRUE |
| Clostridium__butyricum | clade__252 | clade__408 | clade__309 | hetero | ++++ | TRUE | TRUE |
| Clostridium__butyricum | clade__252 | clade__408 | clade__444 | hetero | ++++ | TRUE | TRUE |
| Clostridium__butyricum | clade__252 | clade__408 | clade__408 | semi | ++++ | TRUE | FALSE |
| Clostridium__butyricum | clade__252 | clade__408 | clade__478 | hetero | ++++ | TRUE | TRUE |
| Clostridium__butyricum | clade__252 | clade__408 | clade__260 | hetero | ++++ | TRUE | TRUE |
| Clostridium__butyricum | clade__252 | clade__408 | clade__309 | hetero | ++++ | TRUE | FALSE |
| Clostridium__butyricum | clade__252 | clade__408 | clade__444 | hetero | ++++ | TRUE | TRUE |
| Clostridium__butyricum | clade__252 | clade__478 | clade__478 | semi | ++++ | TRUE | TRUE |
| Clostridium__butyricum | clade__252 | clade__478 | clade__260 | hetero | ++++ | TRUE | TRUE |
| Clostridium__butyricum | clade__252 | clade__478 | clade__309 | hetero | ++++ | TRUE | TRUE |
| Clostridium__butyricum | clade__252 | clade__478 | clade__444 | hetero | ++++ | TRUE | TRUE |
| Clostridium__butyricum | clade__252 | clade__260 | clade__260 | semi | ++++ | TRUE | TRUE |
| Clostridium__butyricum | clade__252 | clade__260 | clade__309 | hetero | ++++ | TRUE | TRUE |
| Clostridium__butyricum | clade__252 | clade__260 | clade__444 | hetero | ++++ | TRUE | TRUE |
| Clostridium__butyricum | clade__252 | clade__309 | clade__309 | semi | ++++ | TRUE | TRUE |
| Clostridium__butyricum | clade__252 | clade__309 | clade__444 | hetero | ++++ | TRUE | TRUE |
| Clostridium__butyricum | clade__252 | clade__444 | clade__444 | semi | ++++ | TRUE | TRUE |
| Clostridium__hylemonae | clade__260 | clade__553 | clade__553 | semi | + | FALSE | FALSE |
| Clostridium__hylemonae | clade__260 | clade__553 | clade__262 | hetero | ++++ | FALSE | TRUE |
| Clostridium__hylemonae | clade__260 | clade__553 | clade__408 | hetero | ++++ | FALSE | FALSE |
| Clostridium__hylemonae | clade__260 | clade__553 | clade__408 | hetero | ++++ | FALSE | FALSE |
| Clostridium__hylemonae | clade__260 | clade__553 | clade__478 | hetero | ++++ | FALSE | TRUE |
| Clostridium__hylemonae | clade__260 | clade__553 | clade__260 | hetero | ++++ | FALSE | TRUE |
| Clostridium__hylemonae | clade__260 | clade__553 | clade__309 | hetero | ++++ | FALSE | TRUE |
| Clostridium__hylemonae | clade__260 | clade__553 | clade__444 | hetero | ++++ | FALSE | TRUE |
| Clostridium__hylemonae | clade__260 | clade__262 | clade__262 | semi | | FALSE | FALSE |

TABLE 4a-continued

| | | | | | |
|---|---|---|---|---|---|
| Clostridium_hylemonae | clade_260 | clade_262 | clade_408 | hetero | ++++ | FALSE | TRUE |
| Clostridium_hylemonae | clade_260 | clade_262 | clade_408 | hetero | ++++ | FALSE | TRUE |
| Clostridium_hylemonae | clade_260 | clade_262 | clade_478 | hetero | ++++ | FALSE | FALSE |
| Clostridium_hylemonae | clade_260 | clade_262 | clade_260 | hetero | ++++ | FALSE | TRUE |
| Clostridium_hylemonae | clade_260 | clade_262 | clade_309 | hetero | + | FALSE | TRUE |
| Clostridium_hylemonae | clade_260 | clade_262 | clade_444 | semi | +, | FALSE | TRUE |
| Clostridium_hylemonae | clade_260 | clade_408 | clade_408 | hetero | ++++ | FALSE | FALSE |
| Clostridium_hylemonae | clade_260 | clade_408 | clade_478 | hetero | ++++ | FALSE | FALSE |
| Clostridium_hylemonae | clade_260 | clade_408 | clade_260 | hetero | ++++ | FALSE | TRUE |
| Clostridium_hylemonae | clade_260 | clade_408 | clade_309 | hetero | ++++ | FALSE | TRUE |
| Clostridium_hylemonae | clade_260 | clade_408 | clade_444 | hetero | ++++ | FALSE | TRUE |
| Clostridium_hylemonae | clade_260 | clade_408 | clade_408 | semi | , | FALSE | FALSE |
| Clostridium_hylemonae | clade_260 | clade_408 | clade_478 | hetero | ++++ | FALSE | FALSE |
| Clostridium_hylemonae | clade_260 | clade_408 | clade_260 | hetero | ++++ | FALSE | TRUE |
| Clostridium_hylemonae | clade_260 | clade_408 | clade_309 | hetero | ++++ | FALSE | TRUE |
| Clostridium_hylemonae | clade_260 | clade_408 | clade_444 | semi | ---- | FALSE | FALSE |
| Clostridium_hylemonae | clade_260 | clade_478 | clade_478 | hetero | ++++ | TRUE | TRUE |
| Clostridium_hylemonae | clade_260 | clade_478 | clade_260 | semi | ++++ | FALSE | TRUE |
| Clostridium_hylemonae | clade_260 | clade_478 | clade_309 | semi | ++++ | TRUE | TRUE |
| Clostridium_hylemonae | clade_260 | clade_478 | clade_444 | hetero | ++++ | FALSE | TRUE |
| Clostridium_hylemonae | clade_260 | clade_260 | clade_260 | hetero | ++++ | FALSE | TRUE |
| Clostridium_hylemonae | clade_260 | clade_260 | clade_309 | hetero | ++++ | FALSE | TRUE |
| Clostridium_hylemonae | clade_260 | clade_260 | clade_444 | semi | ++++ | FALSE | TRUE |
| Clostridium_hylemonae | clade_260 | clade_309 | clade_309 | semi | ++++ | FALSE | TRUE |
| Clostridium_hylemonae | clade_260 | clade_309 | clade_444 | semi | ++++ | FALSE | TRUE |
| Clostridium_orbiscindens | clade_494 | clade_553 | clade_553 | semi | ++++ | FALSE | TRUE |
| Clostridium_orbiscindens | clade_494 | clade_553 | clade_262 | hetero | ++++ | FALSE | TRUE |
| Clostridium_orbiscindens | clade_494 | clade_553 | clade_408 | hetero | ++++ | FALSE | TRUE |
| Clostridium_orbiscindens | clade_494 | clade_553 | clade_478 | hetero | ++++ | FALSE | TRUE |
| Clostridium_orbiscindens | clade_494 | clade_553 | clade_260 | hetero | ++++ | FALSE | FALSE |
| Clostridium_orbiscindens | clade_494 | clade_553 | clade_309 | hetero | ++++ | FALSE | FALSE |
| Clostridium_orbiscindens | clade_494 | clade_553 | clade_444 | hetero | ++++ | FALSE | FALSE |
| Clostridium_orbiscindens | clade_494 | clade_553 | clade_553 | semi | ---- | TRUE | TRUE |
| Clostridium_orbiscindens | clade_494 | clade_553 | clade_262 | semi | +++ | FALSE | TRUE |
| Clostridium_orbiscindens | clade_494 | clade_262 | clade_262 | hetero | ++++ | FALSE | TRUE |
| Clostridium_orbiscindens | clade_494 | clade_262 | clade_408 | hetero | + | TRUE | FALSE |
| Clostridium_orbiscindens | clade_494 | clade_262 | clade_478 | hetero | ++ | FALSE | FALSE |
| Clostridium_orbiscindens | clade_494 | clade_262 | clade_260 | hetero | ---- | FALSE | FALSE |
| Clostridium_orbiscindens | clade_494 | clade_262 | clade_309 | hetero | ++++ | FALSE | FALSE |
| Clostridium_orbiscindens | clade_494 | clade_262 | clade_444 | hetero | ++++ | FALSE | TRUE |
| Clostridium_orbiscindens | clade_494 | clade_408 | clade_408 | semi | +++ | TRUE | FALSE |
| Clostridium_orbiscindens | clade_494 | clade_408 | clade_478 | hetero | ++ | FALSE | FALSE |
| Clostridium_orbiscindens | clade_494 | clade_408 | clade_260 | hetero | ---- | FALSE | FALSE |
| Clostridium_orbiscindens | clade_494 | clade_408 | clade_309 | hetero | ++++ | TRUE | TRUE |
| Clostridium_orbiscindens | clade_494 | clade_408 | clade_444 | hetero | ++++ | FALSE | FALSE |
| Clostridium_orbiscindens | clade_494 | clade_408 | clade_408 | semi | --- | FALSE | FALSE |
| Clostridium_orbiscindens | clade_494 | clade_408 | clade_478 | hetero | ++++ | FALSE | TRUE |
| Clostridium_orbiscindens | clade_494 | clade_408 | clade_260 | hetero | ++ | FALSE | FALSE |
| Clostridium_orbiscindens | clade_494 | clade_408 | clade_309 | hetero | ++++ | FALSE | TRUE |
| Clostridium_orbiscindens | clade_494 | clade_408 | clade_444 | hetero | ++ | FALSE | FALSE |

TABLE 4a-continued

| | | | | | |
|---|---|---|---|---|---|
| Clostridium_orbiscindens | clade_494 | clade_478 | clade_478 | semi | --- | FALSE | FALSE |
| Clostridium_orbiscindens | clade_494 | clade_478 | clade_478 | hetero | | FALSE | FALSE |
| Clostridium_orbiscindens | clade_494 | clade_478 | clade_309 | hetero | ++++ | TRUE | TRUE |
| Clostridium_orbiscindens | clade_494 | clade_478 | clade_444 | semi | --- | FALSE | FALSE |
| Clostridium_orbiscindens | clade_494 | clade_260 | clade_260 | semi | | FALSE | FALSE |
| Clostridium_orbiscindens | clade_494 | clade_260 | clade_309 | hetero | ++++ | TRUE | TRUE |
| Clostridium_orbiscindens | clade_494 | clade_260 | clade_444 | hetero | +++ | FALSE | FALSE |
| Clostridium_orbiscindens | clade_494 | clade_309 | clade_309 | semi | ++++ | TRUE | TRUE |
| Clostridium_orbiscindens | clade_494 | clade_309 | clade_444 | hetero | ++++ | TRUE | TRUE |
| Clostridium_orbiscindens | clade_494 | clade_444 | clade_444 | semi | - | FALSE | FALSE |
| Ruminococcus_gnavus | clade_360 | clade_553 | clade_553 | semi | | FALSE | FALSE |
| Ruminococcus_gnavus | clade_360 | clade_553 | clade_262 | hetero | + | FALSE | FALSE |
| Ruminococcus_gnavus | clade_360 | clade_553 | clade_408 | hetero | ++++ | FALSE | FALSE |
| Ruminococcus_gnavus | clade_360 | clade_553 | clade_478 | hetero | ++++ | FALSE | FALSE |
| Ruminococcus_gnavus | clade_360 | clade_553 | clade_260 | hetero | ++++ | FALSE | FALSE |
| Ruminococcus_gnavus | clade_360 | clade_553 | clade_309 | hetero | ++++ | FALSE | TRUE |
| Ruminococcus_gnavus | clade_360 | clade_553 | clade_444 | hetero | ++++ | FALSE | TRUE |
| Ruminococcus_gnavus | clade_360 | clade_262 | clade_262 | semi | - | FALSE | FALSE |
| Ruminococcus_gnavus | clade_360 | clade_262 | clade_408 | hetero | ++++ | FALSE | FALSE |
| Ruminococcus_gnavus | clade_360 | clade_262 | clade_478 | hetero | --- | FALSE | TRUE |
| Ruminococcus_gnavus | clade_360 | clade_262 | clade_260 | hetero | ++++ | FALSE | FALSE |
| Ruminococcus_gnavus | clade_360 | clade_262 | clade_309 | hetero | ++++ | FALSE | FALSE |
| Ruminococcus_gnavus | clade_360 | clade_262 | clade_444 | semi | ++++ | FALSE | FALSE |
| Ruminococcus_gnavus | clade_360 | clade_408 | clade_408 | hetero | +++ | FALSE | FALSE |
| Ruminococcus_gnavus | clade_360 | clade_408 | clade_478 | hetero | ++++ | FALSE | FALSE |
| Ruminococcus_gnavus | clade_360 | clade_408 | clade_260 | hetero | ++++ | FALSE | TRUE |
| Ruminococcus_gnavus | clade_360 | clade_408 | clade_309 | hetero | ++++ | TRUE | TRUE |
| Ruminococcus_gnavus | clade_360 | clade_408 | clade_444 | semi | | FALSE | FALSE |
| Ruminococcus_gnavus | clade_360 | clade_478 | clade_478 | hetero | ++++ | FALSE | FALSE |
| Ruminococcus_gnavus | clade_360 | clade_478 | clade_260 | hetero | ++++ | FALSE | TRUE |
| Ruminococcus_gnavus | clade_360 | clade_478 | clade_309 | hetero | ++++ | FALSE | TRUE |
| Ruminococcus_gnavus | clade_360 | clade_478 | clade_444 | hetero | ++++ | FALSE | FALSE |
| Ruminococcus_gnavus | clade_360 | clade_260 | clade_260 | semi | ++++ | FALSE | TRUE |
| Ruminococcus_gnavus | clade_360 | clade_260 | clade_309 | hetero | ++++ | FALSE | TRUE |
| Ruminococcus_gnavus | clade_360 | clade_260 | clade_444 | hetero | ++++ | TRUE | TRUE |
| Ruminococcus_gnavus | clade_360 | clade_309 | clade_309 | semi | ++++ | FALSE | TRUE |
| Ruminococcus_gnavus | clade_360 | clade_309 | clade_444 | hetero | ++++ | TRUE | TRUE |
| Ruminococcus_gnavus | clade_360 | clade_444 | clade_444 | semi | ++++ | FALSE | TRUE |

TABLE 4b

| OTU1 | ID1 | OTU2 | ID2 | OTU3 | ID3 | Clade1 | Clade2 | Clade3 |
|---|---|---|---|---|---|---|---|---|
| *Bacteroides* sp. 1_1_6 | 295 | *Clostridium* sp. HGF2 | 628 | | | clade_65 | clade_351 | |
| *Bacteroides* sp. 1_1_6 | 295 | *Bifidobacterium pseudocatenulatum* | 357 | | | clade_65 | clade_172 | |
| *Bacteroides* sp. 1_1_6 | 295 | *Clostridium symbiosum* | 652 | | | clade_65 | clade_408 | |
| *Bacteroides* sp. 3_1_23 | 308 | *Clostridium nexile* | 607 | | | clade_38 | clade_262 | |
| *Bacteroides* sp. 3_1_23 | 308 | *Bifidobacterium pseudocatenulatum* | 357 | | | clade_38 | clade_172 | |
| *Bacteroides* sp. 3_1_23 | 308 | *Clostridium symbiosum* | 652 | | | clade_38 | clade_408 | |
| *Streptococcus thermophilus* | 1883 | *Bifidobacterium pseudocatenulatum* | 357 | | | clade_98 | clade_172 | |
| *Clostridium nexile* | 607 | *Bifidobacterium pseudocatenulatum* | 357 | | | clade_262 | clade_172 | |
| *Parabacteroides merdae* | 1420 | *Bifidobacterium pseudocatenulatum* | 357 | | | clade_286 | clade_172 | |
| *Clostridium tertium* | 653 | *Clostridium mayombei* | 605 | | | clade_252 | clade_354 | |
| *Clostridium tertium* | 653 | *Clostridium butyricum* | 561 | | | clade_252 | clade_252 | |
| *Clostridium tertium* | 653 | *Coprococcus comes* | 674 | | | clade_252 | clade_262 | |
| *Clostridium tertium* | 653 | *Clostridium hylemonae* | 593 | | | clade_252 | clade_260 | |
| *Clostridium tertium* | 653 | *Clostridium orbiscindens* | 609 | | | clade_252 | clade_494 | |
| *Clostridium tertium* | 653 | *Lachnospiraceae bacterium 5_1_57FAA* | 1054 | | | clade_252 | clade_260 | |
| *Clostridium tertium* | 653 | *Ruminococcus gnavus* | 1661 | | | clade_252 | clade_360 | |
| *Clostridium tertium* | 653 | *Ruminococcus bromii* | 1657 | | | clade_252 | clade_537 | |
| *Clostridium disporicum* | 579 | *Clostridium mayombei* | 605 | | | clade_253 | clade_354 | |
| *Clostridium disporicum* | 579 | *Clostridium butyricum* | 561 | | | clade_253 | clade_252 | |
| *Clostridium disporicum* | 579 | *Clostridium orbiscindens* | 609 | | | clade_253 | clade_494 | |
| *Clostridium disporicum* | 579 | *Ruminococcus gnavus* | 1661 | | | clade_253 | clade_360 | |
| *Clostridium mayombei* | 605 | *Clostridium butyricum* | 561 | | | clade_354 | clade_252 | |
| *Clostridium mayombei* | 605 | *Coprococcus comes* | 674 | | | clade_354 | clade_262 | |
| *Clostridium mayombei* | 605 | *Clostridium hylemonae* | 593 | | | clade_354 | clade_260 | |
| *Clostridium mayombei* | 605 | *Clostridium symbiosum* | 652 | | | clade_354 | clade_408 | |
| *Clostridium mayombei* | 605 | *Clostridium orbiscindens* | 609 | | | clade_354 | clade_494 | |
| *Clostridium mayombei* | 605 | *Lachnospiraceae bacterium 5_1_57FAA* | 1054 | | | clade_354 | clade_260 | |
| *Clostridium mayombei* | 605 | *Ruminococcus gnavus* | 1661 | | | clade_354 | clade_360 | |
| *Clostridium mayombei* | 605 | *Ruminococcus bromii* | 1657 | | | clade_354 | clade_537 | |
| *Clostridium butyricum* | 561 | *Clostridium mayombei* | 605 | | | clade_252 | clade_354 | |
| *Clostridium butyricum* | 561 | *Coprococcus comes* | 674 | | | clade_252 | clade_262 | |
| *Clostridium butyricum* | 561 | *Clostridium hylemonae* | 593 | | | clade_252 | clade_260 | |
| *Clostridium butyricum* | 561 | *Clostridium symbiosum* | 652 | | | clade_252 | clade_408 | |
| *Clostridium butyricum* | 561 | *Clostridium orbiscindens* | 609 | | | clade_252 | clade_494 | |
| *Clostridium butyricum* | 561 | *Lachnospiraceae bacterium 5_1_57FAA* | 1054 | | | clade_252 | clade_260 | |
| *Clostridium butyricum* | 561 | *Ruminococcus gnavus* | 1661 | | | clade_252 | clade_360 | |
| *Clostridium butyricum* | 561 | *Ruminococcus bromii* | 1657 | | | clade_252 | clade_537 | |
| *Coprococcus comes* | 674 | *Clostridium butyricum* | 561 | | | clade_262 | clade_252 | |
| *Coprococcus comes* | 674 | *Ruminococcus gnavus* | 1661 | | | clade_262 | clade_360 | |
| *Clostridium hylemonae* | 593 | *Lachnospiraceae bacterium 5_1_57FAA* | 1054 | | | clade_260 | clade_260 | |
| *Clostridium orbiscindens* | 609 | *Ruminococcus gnavus* | 1661 | | | clade_494 | clade_360 | |
| *Coprococcus comes* | 674 | *Clostridium tertium* | 653 | *Clostridium mayombei* | 605 | clade_262 | clade_252 | clade_354 |
| *Coprococcus comes* | 674 | *Clostridium tertium* | 653 | *Clostridium butyricum* | 561 | clade_262 | clade_252 | clade_252 |
| *Coprococcus comes* | 674 | *Clostridium tertium* | 653 | *Clostridium orbiscindens* | 609 | clade_262 | clade_252 | clade_494 |
| *Coprococcus comes* | 674 | *Clostridium disporicum* | 579 | *Clostridium butyricum* | 561 | clade_262 | clade_253 | clade_252 |
| *Coprococcus comes* | 674 | *Clostridium mayombei* | 605 | *Clostridium butyricum* | 561 | clade_262 | clade_354 | clade_252 |
| *Coprococcus comes* | 674 | *Clostridium butyricum* | 561 | *Clostridium hylemonae* | 593 | clade_262 | clade_252 | clade_260 |
| *Coprococcus comes* | 674 | *Clostridium butyricum* | 561 | *Clostridium orbiscindens* | 609 | clade_262 | clade_252 | clade_494 |
| *Coprococcus comes* | 674 | *Clostridium butyricum* | 561 | *Ruminococcus gnavus* | 1661 | clade_262 | clade_252 | clade_360 |
| *Coprococcus comes* | 674 | *Clostridium butyricum* | 561 | *Ruminococcus bromii* | 1657 | clade_262 | clade_252 | clade_537 |
| *Clostridium symbiosum* | 652 | *Clostridium tertium* | 653 | *Clostridium mayombei* | 605 | clade_408 | clade_252 | clade_354 |
| *Clostridium symbiosum* | 652 | *Clostridium tertium* | 653 | *Clostridium butyricum* | 561 | clade_408 | clade_252 | clade_252 |
| *Clostridium symbiosum* | 652 | *Clostridium disporicum* | 579 | *Clostridium butyricum* | 561 | clade_408 | clade_253 | clade_252 |
| *Clostridium symbiosum* | 652 | *Clostridium mayombei* | 605 | *Clostridium orbiscindens* | 609 | clade_408 | clade_354 | clade_494 |
| *Clostridium symbiosum* | 652 | *Clostridium mayombei* | 605 | *Ruminococcus bromii* | 1657 | clade_408 | clade_354 | clade_537 |
| *Clostridium symbiosum* | 652 | *Clostridium butyricum* | 561 | *Clostridium hylemonae* | 593 | clade_408 | clade_252 | clade_260 |
| *Clostridium symbiosum* | 652 | *Clostridium butyricum* | 561 | *Clostridium orbiscindens* | 609 | clade_408 | clade_252 | clade_494 |
| *Clostridium symbiosum* | 652 | *Clostridium butyricum* | 561 | *Ruminococcus gnavus* | 1661 | clade_408 | clade_252 | clade_360 |
| *Clostridium symbiosum* | 652 | *Clostridium butyricum* | 561 | *Ruminococcus bromii* | 1657 | clade_408 | clade_252 | clade_537 |
| *Lachnospiraceae bacterium 5_1_57FAA* | 1054 | *Clostridium tertium* | 653 | *Clostridium butyricum* | 561 | clade_260 | clade_252 | clade_252 |
| *Lachnospiraceae bacterium 5_1_57FAA* | 1054 | *Clostridium disporicum* | 579 | *Clostridium butyricum* | 561 | clade_260 | clade_253 | clade_252 |
| *Lachnospiraceae bacterium 5_1_57FAA* | 1054 | *Clostridium mayombei* | 605 | *Ruminococcus gnavus* | 1661 | clade_260 | clade_354 | clade_360 |
| *Lachnospiraceae bacterium 5_1_57FAA* | 1054 | *Clostridium mayombei* | 605 | *Ruminococcus bromii* | 1657 | clade_260 | clade_354 | clade_537 |
| *Lachnospiraceae bacterium 5_1_57FAA* | 1054 | *Clostridium butyricum* | 561 | *Clostridium hylemonae* | 593 | clade_260 | clade_252 | clade_260 |

TABLE 4b-continued

| OTU1 | ID1 | OTU2 | ID2 | OTU3 | ID3 | Clade1 | Clade2 | Clade3 |
|---|---|---|---|---|---|---|---|---|
| Lachnospiraceae bacterium 5_1_57FAA | 1054 | *Clostridium butyricum* | 561 | *Clostridium orbiscindens* | 609 | clade_260 | clade_252 | clade_494 |
| Lachnospiraceae bacterium 5_1_57FAA | 1054 | *Clostridium butyricum* | 561 | *Ruminococcus gnavus* | 1661 | clade_260 | clade_252 | clade_360 |
| Lachnospiraceae bacterium 5_1_57FAA | 1054 | *Clostridium butyricum* | 561 | *Ruminococcus bromii* | 1657 | clade_260 | clade_252 | clade_537 |
| *Clostridium butyricum* | 561 | *Coprococcus comes* | 674 | *Clostridium symbiosum* | 652 | clade_252 | clade_262 | clade_408 |
| *Clostridium butyricum* | 561 | *Coprococcus comes* | 674 | Lachnospiraceae bacterium 5_1_57FAA | 1054 | clade_252 | clade_262 | clade_260 |
| *Clostridium butyricum* | 561 | *Clostridium symbiosum* | 652 | Lachnospiraceae bacterium 5_1_57FAA | 1054 | clade_252 | clade_408 | clade_260 |

TABLE 5

| Expt. Mort. | SP Arm Clade1 | Key Clade2 | Seres Arm Clade3 | Treatment | OTU1 | OTU2 | OTU3 | CivSim Inhibition (log10 CFU/mL) |
|---|---|---|---|---|---|---|---|---|
| SP427 | 1 | PBS | 1 | Vehicle | | | | n/a |
| SP427 | 14 | V5F | 2 | FSV33_10pct (FMT) | | | | n/a |
| SP427 | 6 | 79F | 3 | DE277512.1 | *Collinsella aerofaciens* | *Faecalibacterium prausnitzii* | *Blautia producta* | 1.84 |
| SP427 | 12 | V7B | 4 | DE643314.1 | *Faecalibacterium prausnitzii* | *Blautia producta* | *Eubacterium rectale* | 1.27 |
| SP427 | 5 | 699 | 5 | DE022136.1 | *Clostridium bolteae* | Lachnospiraceae bacterium 5_1_57FAA | *Blautia producta* | 0.81 |
| SP427 | 10 | E4W | 6 | DE061176.1 | *Collinsella aerofaciens* | *Clostridium butyricum* | *Ruminococcus gnavus* | 2.87 |
| SP427 | 7 | 852 | 7 | DE554703.1 | *Collinsella aerofaciens* | *Clostridium butyricum* | *Clostridium hylemonae* | 3.09 |
| SP427 | 3 | 366 | 8 | DE705158.1 | *Coprococcus comes* | *Clostridium innocuum* | *Clostridium butyricum* | 3 |
| SP427 | 9 | CE3 | 9 | DE266960.1 | *Clostridium bolteae* | *Clostridium butyricum* | *Ruminococcus gnavus* | 3.06 |
| SP427 | 8 | BCY | 10 | DE897971.1 | *Clostridium mayombei* | *Collinsella aerofaciens* | *Clostridium symbiosum* | 1.46 |
| SP427 | 13 | Y4K | 11 | DE001210.1 | *Clostridium tertium* | *Collinsella aerofaciens* | *Blautia producta* | 2 |
| SP427 | 11 | FBK | 12 | DE586246.1 | *Clostridium mayombei* | Lachnospiraceae bacterium 5_1_57FAA | *Blautia producta* | 1.88 |
| SP427 | 4 | 3R1 | 13 | DE844277.1 | *Coprococcus comes* | *Clostridium mayombei* | *Blautia* sp. M25 | 2.1 |
| SP427 | 2 | 1HR | 14 | DE208485.1 | *Coprococcus comes* | *Clostridium tertium* | *Clostridium orbiscindens* | 1.8 |
| SP427 | 31 | PBS NoCdiff | 31 | Naive | | | | n/a |

| Expt. Mort. | SP Arm Clade1 | Key Clade2 | Seres Arm Clade3 | CivSim Inhibition (Confidence) | Mean Min. Rel. Weight | Mean Max. Clin. Score | Cum. | | | |
|---|---|---|---|---|---|---|---|---|---|---|
| SP427 | 1 | PBS | 1 | n/a | 0.82 | 2.6 | 3 | | | |
| SP427 | 14 | V5F | 2 | n/a | 0.99 | 0 | 0 | | | |
| SP427 | 6 | 79F | 3 | ++++ | 0.85 | 1.4 | 1 | clade_553 | clade_478 | clade_309 |
| SP427 | 12 | V7B | 4 | ++++ | 0.81 | 2 | 3 | clade_478 | clade_309 | clade_444 |
| SP427 | 5 | 699 | 5 | ++++ | 0.93 | 1 | 0 | clade_408 | clade_260 | clade_309 |
| SP427 | 10 | E4W | 6 | ++++ | 0.96 | 0.2 | 0 | clade_553 | clade_252 | clade_360 |
| SP427 | 7 | 852 | 7 | ++++ | 0.78 | 1.7 | 2 | clade_553 | clade_252 | clade_260 |
| SP427 | 3 | 366 | 8 | ++++ | 0.85 | 1.7 | 2 | clade_262 | clade_351 | clade_252 |
| SP427 | 9 | CE3 | 9 | ++++ | 0.91 | 1 | 0 | clade_408 | clade_252 | clade_360 |
| SP427 | 8 | BCY | 10 | ++++ | 0.83 | 1.7 | 1 | clade_354 | clade_553 | clade_408 |
| SP427 | 13 | Y4K | 11 | ++++ | 0.88 | 1.1 | 0 | clade_252 | clade_553 | clade_309 |
| SP427 | 11 | FBK | 12 | ++++ | 0.94 | 1 | 0 | clade_354 | clade_260 | clade_309 |
| SP427 | 4 | 3R1 | 13 | ++++ | 0.88 | 1 | 0 | clade_262 | clade_354 | clade_309 |
| SP427 | 2 | 1HR | 14 | ++++ | 0.89 | 1.3 | 1 | clade_262 | clade_252 | clade_494 |
| SP427 | 31 | PBS NoCdiff | 31 | n/a | 1 | 0 | 0 | | | |

TABLE 6

| Initial Concentration of VRE (log10 CFU/mL) | Initial Concentration of Ecobiotic ™ Composition (log10 CFU/mL/Strain) | Incubation Time (h) | Inhibition (log10 CFU/mL) |
|---|---|---|---|
| 3 | 6 | 15 | 3.1 |
| 3 | 4 | 15 | 1.3 |
| 2 | 6 | 15 | 5.2 |
| 2 | 4 | 15 | 1.6 |
| 3 | 6 | 24 | 2.7 |
| 3 | 4 | 24 | 0.7 |
| 2 | 6 | 24 | 4.6 |

TABLE 7

| Initial Concentration of K. pneumoniae (log10 CFU/mL) | Initial Concentration of Ecobiotic ™ Composition (log10 CFU/mL/Strain) | Incubation Time (h) | Inhibition (log10 CFU/mL) |
|---|---|---|---|
| 3 | 6 | 15 | 2.5 |
| 3 | 4 | 15 | 0.4 |
| 2 | 6 | 15 | 4.2 |
| 2 | 4 | 15 | 1.2 |
| 3 | 6 | 24 | 1.7 |
| 3 | 4 | 24 | 0.2 |
| 2 | 6 | 24 | 3.1 |
| 2 | 4 | 24 | 0.1 |

TABLE 8

| Initial Concentration of M. morganii (log10 CFU/mL) | Initial Concentration of Ecobiotic ™ Composition (log10 CFU/mL/Strain) | Incubation Time (h) | Inhibition (log10 CFU/mL) |
|---|---|---|---|
| 3 | 6 | 15 | 4.3 |
| 3 | 4 | 15 | 2.1 |
| 2 | 6 | 15 | 5.8 |
| 2 | 4 | 15 | 3.3 |
| 3 | 6 | 24 | 3.9 |
| 3 | 4 | 24 | 1.4 |
| 2 | 6 | 24 | 5.1 |
| 2 | 4 | 24 | 2.5 |

TABLE 9

| SP Expt. | SP Arm | Test Article | Target Dose (CFU/OTU/mouse) | Cumulative Mortality (%) | Mean Min. Rel. Weight | Mean Max. Clin. Score (Death = 4) |
|---|---|---|---|---|---|---|
| SP-327 | 3 | Vehicle Control | | 30 | 0.89 | 2.2 |
| SP-327 | 4 | Vanco. Positive Control | | 0 | 0.99 | 1 |
| SP-327 | 12 | N1957 | 2.0E+07 | 0 | 0.87 | 0 |
| SP-327 | 13 | N1957 | 2.0E+06 | 40 | 0.86 | 2.2 |
| SP-327 | 14 | N1957 | 2.0E+05 | 50 | 0.80 | 2.8 |
| SP-338 | 1 | Vehicle Control | | 60 | 0.81 | 3.2 |
| SP-338 | 2 | Vanco. Positive Control | | 0 | 1.00 | 0 |
| SP-338 | 3 | 10% fecal suspension | | 0 | 0.95 | 1 |
| SP-338 | 5 | N1957 | 2.0E+07 | 10 | 0.80 | 2 |
| SP-338 | 6 | N1957 | 2.0E+06 | 0 | 0.97 | 1 |
| SP-338 | 7 | N1957 | 2.0E+05 | 20 | 0.85 | 1.7 |
| SP-338 | 11 | N1957 | 2.0E+07 | 20 | 0.86 | 2 |
| SP-338 | 12 | N1957 | 2.0E+06 | 30 | 0.83 | 2.5 |
| SP-338 | 13 | N1961 | 2.0E+07 | 10 | 0.93 | 1.3 |
| SP-338 | 14 | N1955 | 2.0E+07 | 0 | 0.91 | 1.2 |
| SP-338 | 15 | N1955 | 2.0E+06 | 10 | 0.90 | 1.5 |
| SP-338 | 16 | N1955 | 2.0E+05 | 10 | 0.89 | 2.7 |
| SP-338 | 17 | N1967 | 2.0E+07 | 10 | 0.94 | 1.4 |
| SP-338 | 18 | N1983 | 2.0E+07 | 0 | 0.92 | 1 |
| SP-338 | 19 | N1989 | 2.0E+07 | 10 | 0.91 | 1.3 |
| SP-338 | 20 | N1996 | 2.0E+07 | 10 | 0.93 | 1.3 |
| SP-338 | 21 | Naïve | | 0 | 1.00 | 0 |
| SP-339 | 1 | Vehicle Control | | 20 | 0.88 | 2.2 |
| SP-339 | 2 | Vanco. Positive Control | | 0 | 0.99 | 0 |
| SP-339 | 3 | 10% fecal suspension | | 0 | 0.97 | 0 |
| SP-339 | 4 | N1995 | 2.0E+07 | 20 | 0.83 | 2.1 |
| SP-339 | 5 | N1995 | 2.0E+06 | 10 | 0.91 | 1.5 |
| SP-339 | 6 | N1995 | 2.0E+05 | 0 | 0.96 | 1.2 |
| SP-339 | 7 | N1950 | 2.0E+07 | 0 | 0.94 | 1 |
| SP-339 | 8 | N1994 | 2.0E+07 | 20 | 0.87 | 1.8 |
| SP-339 | 9 | N1997 | 2.0E+07 | 0 | 0.95 | 1.2 |
| SP-339 | 10 | N1967 | 2.0E+07 | 0 | 0.93 | 1.2 |
| SP-339 | 11 | N1983 | 2.0E+07 | 10 | 0.83 | 2.2 |
| SP-339 | 12 | N1989 | 2.0E+07 | 0 | 0.88 | 1.5 |
| SP-339 | 13 | N1996 | 2.0E+07 | 0 | 0.97 | 1 |
| SP-339 | 14 | N2002 | 2.0E+07 | 20 | 0.92 | 2 |
| SP-339 | 15 | N2000 | 2.0E+07 | 0 | 0.98 | 1.2 |
| SP-339 | 21 | Naïve | | 0 | 0.98 | 0 |
| SP-342 | 1 | Vehicle Control | | 40 | 0.85 | 2.5 |
| SP-342 | 2 | Vanco. Positive Control | | 0 | 1.00 | 0 |
| SP-342 | 5 | N1957 | 2.0E+08 | 0 | 0.94 | 0.2 |

TABLE 9-continued

| SP Expt. | SP Arm | Test Article | Target Dose (CFU/OTU/ mouse) | Cumulative Mortality (%) | Mean Min. Rel. Weight | Mean Max. Clin. Score (Death = 4) |
|---|---|---|---|---|---|---|
| SP-342 | 6 | N1957 | 2.0E+07 | 0 | 0.96 | 0 |
| SP-342 | 7 | N1957 | 2.0E+06 | 10 | 0.88 | 1.3 |
| SP-342 | 8 | N1980 | 2.0E+08 | 10 | 0.92 | 1.8 |
| SP-342 | 9 | N1998 | 2.0E+08 | 20 | 0.83 | 2.8 |
| SP-342 | 10 | N1976 | 2.0E+08 | 10 | 0.92 | 1.4 |
| SP-342 | 11 | N1987 | 2.0E+08 | 10 | 0.93 | 1.6 |
| SP-342 | 12 | N2005 | 2.0E+08 | 20 | 0.86 | 2.4 |
| SP-342 | 13 | N1958 | 2.0E+08 | 0 | 0.94 | 1.5 |
| SP-342 | 34 | N2004 | 2.0E+08 | 10 | 0.93 | 1.4 |
| SP-342 | 15 | N1949 | 2.0E+08 | 10 | 0.87 | 1.5 |
| SP-342 | 18 | N1970 | 2.0E+08 | 50 | 0.81 | 3 |
| SP-342 | 21 | Naïve | | 0 | 0.99 | 0 |
| SP-361 | 1 | Vehicle Control | | 30 | 0.88 | 2.6 |
| SP-361 | 2 | 10% fecal suspension | | 0 | 0.99 | 0 |
| SP-361 | 3 | N435 | 1.0E+07 | 80 | 0.83 | 3.6 |
| SP-361 | 4 | N1979 | 1.0E+07 | 0 | 0.97 | 0 |
| SP-361 | 5 | N414 | 1.0E+07 | 0 | 0.97 | 0 |
| SP-361 | 6 | N512 | 1.0E+07 | 20 | 0.94 | 1.6 |
| SP-361 | 7 | N582 | 1.0E+07 | 10 | 0.93 | 0.9 |
| SP-361 | 8 | N571 | 1.0E+07 | 30 | 0.88 | 2.1 |
| SP-361 | 9 | N510 | 1.0E+07 | 0 | 0.93 | 0.3 |
| SP-361 | 10 | N1981 | 1.0E+07 | 40 | 0.83 | 2.8 |
| SP-361 | 11 | N1969 | 1.0E+07 | 80 | 0.82 | 3.6 |
| SP-361 | 12 | N461 | 1.0E+07 | 10 | 0.89 | 1.2 |
| SP-361 | 13 | N460 | 1.0E+07 | 0 | 0.93 | 1.1 |
| SP-361 | 14 | N1959 | 1.0E+07 | 30 | 0.89 | 1.9 |
| SP-361 | 15 | N2006 | 1.0E+07 | 30 | 0.89 | 1.9 |
| SP-361 | 16 | N1953 | 1.0E+07 | 10 | 0.83 | 2.3 |
| SP-361 | 17 | N1960 | 1.0E+07 | 0 | 0.92 | 1 |
| SP-361 | 18 | N2007 | 1.0E+07 | 10 | 0.91 | 0.9 |
| SP-361 | 19 | N1978 | 1.0E+07 | 10 | 0.91 | 1.3 |
| SP-361 | 20 | N1972 | 1.0E+07 | 30 | 0.83 | 2.6 |
| SP-361 | 21 | Naïve | | 0 | 1.00 | 0 |
| SP-363 | 1 | Vehicle Control | | 30 | 0.85 | 2.6 |
| SP-363 | 2 | 10% fecal suspension | | 0 | 0.95 | 0 |
| SP-363 | 8 | N1974 | 1.0E+07 | 60 | 0.81 | 3.2 |
| SP-363 | 9 | N582 | 1.0E+07 | 60 | 0.81 | 3.2 |
| SP-363 | 10 | N435 | 1.0E+07 | 30 | 0.86 | 2.1 |
| SP-363 | 11 | N414 | 1.0E+07 | 40 | 0.83 | 2.5 |
| SP-363 | 12 | N457 | 1.0E+07 | 30 | 0.83 | 2.2 |
| SP-363 | 13 | N511 | 1.0E+07 | 20 | 0.87 | 2 |
| SP-363 | 14 | N513 | 1.0E+07 | 0 | 0.88 | 0.2 |
| SP-363 | 15 | N682 | 1.0E+07 | 30 | 0.82 | 2.6 |
| SP-363 | 16 | N736 | 1.0E+07 | 40 | 0.82 | 2.8 |
| SP-363 | 17 | N732 | 1.0E+07 | 10 | 0.86 | 1.3 |
| SP-363 | 18 | N1948 | 1.0E+07 | 60 | 0.85 | 3.2 |
| SP-363 | 19 | N853 | 1.0E+07 | 10 | 0.85 | 2.2 |
| SP-363 | 20 | N1979 | 1.0E+07 | 60 | 0.78 | 3.2 |
| SP-363 | 21 | N879 | 1.0E+07 | 40 | 0.83 | 2.8 |
| SP-363 | 22 | N999 | 1.0E+07 | 20 | 0.88 | 2.4 |
| SP-363 | 23 | N975 | 1.0E+07 | 30 | 0.80 | 2.6 |
| SP-363 | 24 | N861 | 1.0E+07 | 50 | 0.85 | 3 |
| SP-363 | 25 | N1095 | 1.0E+07 | 80 | 0.83 | 3.6 |
| SP-363 | 26 | Naïve | | 0 | 1.00 | 0 |
| SP-364 | 1 | Vehicle Control | | 40 | 0.83 | 2.8 |
| SP-364 | 4 | N582 | 1.0E+07 | 0 | 0.81 | 0.9 |
| SP-364 | 5 | N582 | 1.0E+06 | 0 | 0.84 | 0.9 |
| SP-364 | 6 | N582 | 1.0E+05 | 40 | 0.76 | 2.5 |
| SP-364 | 13 | N414 | 1.0E+07 | 0 | 0.84 | 0 |
| SP-364 | 14 | N414 | 1.0E+06 | 30 | 0.79 | 2.4 |
| SP-364 | 15 | N414 | 1.0E+05 | 10 | 0.76 | 2 |
| SP-364 | 22 | 10% fecal suspension | | 0 | 0.97 | 0 |
| SP-364 | 23 | Naïve | | 0 | 0.99 | 0 |
| SP-365 | 1 | Vehicle Control | | 40 | 0.83 | 2.8 |
| SP-365 | 4 | 10% fecal suspension | | 0 | 0.98 | 0 |
| SP-365 | 13 | N582 | 1.0E+07 | 60 | 0.80 | 3.2 |
| SP-365 | 14 | N582 | 1.0E+06 | 10 | 0.89 | 1.5 |
| SP-365 | 15 | N414 | 1.0E+07 | 20 | 0.86 | 1.7 |
| SP-365 | 16 | N414 | 1.0E+06 | 80 | 0.83 | 3.5 |
| SP-365 | 21 | Naïve | | 0 | 1.00 | 0 |
| SP-366 | 1 | Vehicle Control | | 20 | 0.82 | 2.4 |
| SP-366 | 4 | 10% fecal suspension | | 0 | 0.93 | 1 |
| SP-366 | 7 | N582 | 1.0E+07 | 0 | 0.86 | 1 |
| SP-366 | 10 | N414 | 1.0E+07 | 20 | 0.83 | 2.4 |
| SP-366 | 13 | N402 | 1.0E+07 | 30 | 0.81 | 2.1 |

TABLE 9-continued

| SP Expt. | SP Arm | Test Article | Target Dose (CFU/OTU/ mouse) | Cumulative Mortality (%) | Mean Min. Rel. Weight | Mean Max. Clin. Score (Death = 4) |
|---|---|---|---|---|---|---|
| SP-366 | 16 | N1982 | 1.0E+07 | 0 | 0.90 | 1.1 |
| SP-366 | 19 | N460 | 1.0E+07 | 10 | 0.83 | 2.2 |
| SP-366 | 22 | N513 | 6.7E+06 | 40 | 0.82 | 2.8 |
| SP-366 | 23 | N1966 | 1.0E+07 | 0 | 0.90 | 0.5 |
| SP-366 | 24 | N1977 | 1.0E+07 | 20 | 0.83 | 1.9 |
| SP-366 | 25 | N1979 | 1.0E+07 | 20 | 0.83 | 2.4 |
| SP-366 | 26 | N682 | 1.0E+07 | 20 | 0.83 | 2.3 |
| SP-366 | 27 | N1947 | 1.0E+07 | 10 | 0.82 | 1.3 |
| SP-366 | 28 | N582 | 1.0E+07 | 20 | 0.82 | 1.8 |
| SP-366 | 29 | N414 | 1.0E+07 | 0 | 0.85 | 1.5 |
| SP-366 | 30 | N603 | 1.0E+07 | 30 | 0.82 | 2.2 |
| SP-366 | 31 | Naïve | | 0 | 0.99 | 0 |
| SP-368 | 1 | Vehicle Control | | 50 | 0.85 | 2.8 |
| SP-368 | 2 | 10% fecal suspension | | 0 | 0.97 | 0 |
| SP-368 | 7 | N1966 | 1.0E+07 | 0 | 0.89 | 1 |
| SP-368 | 8 | N1966 | 1.0E+06 | 10 | 0.91 | 1.5 |
| SP-368 | 9 | N1966 | 1.0E+05 | 50 | 0.82 | 3.1 |
| SP-368 | 21 | Naïve | | 0 | 1.00 | 0 |
| SP-374 | 1 | Vehicle Control | | 100 | 0.83 | 4 |
| SP-374 | 4 | 10% fecal suspension | | 10 | 0.89 | 0.5 |
| SP-374 | 11 | N1966 | 1.0E+08 | 0 | 0.87 | 1 |
| SP-374 | 12 | N1966 | 1.0E+08 | 0 | 0.91 | 0.5 |
| SP-374 | 13 | N1966 | 1.0E+07 | 10 | 0.88 | 1.3 |
| SP-374 | 14 | N1966 | 1.0E+06 | 50 | 0.79 | 3 |
| SP-374 | 15 | N584 | 1.0E+08 | 0 | 0.89 | 1 |
| SP-374 | 16 | N584 | 1.0E+07 | 30 | 0.84 | 2.4 |
| SP-374 | 17 | N1962 | 1.0E+07 | 0 | 0.93 | 0 |
| SP-374 | 18 | N382 | 1.0E+07 | 10 | 0.85 | 1.5 |
| SP-374 | 19 | N1964 | 1.0E+07 | 20 | 0.89 | 1.8 |
| SP-374 | 20 | N1965 | 1.0E+07 | 30 | 0.85 | 2.1 |
| SP-374 | 21 | N306 | 1.0E+07 | 10 | 0.90 | 0.4 |
| SP-374 | 22 | N1988 | 1.0E+07 | 0 | 0.89 | 1 |
| SP-374 | 23 | N2003 | 1.0E+07 | 0 | 0.92 | 1.2 |
| SP-374 | 24 | N1993 | 1.0E+07 | 20 | 0.77 | 2.4 |
| SP-374 | 25 | Naïve | | 0 | 0.99 | 0 |
| SP-376 | 1 | Vehicle Control | | 60 | 0.83 | 3.2 |
| SP-376 | 2 | 10% fecal suspension | | 0 | 0.98 | 0 |
| SP-376 | 3 | N1966 | 1.0E+08 | 30 | 0.79 | 2.4 |
| SP-376 | 4 | N1966 | 1.0E+07 | 0 | 0.95 | 0 |
| SP-376 | 5 | N1966 | 1.0E+08 | 30 | 0.79 | 2.6 |
| SP-376 | 6 | N1966 | 1.0E+07 | 10 | 0.88 | 2.2 |
| SP-376 | 7 | N1986 | 1.0E+07 | 40 | 0.80 | 2.8 |
| SP-376 | 8 | N1962 | 1.0E+08 | 0 | 0.98 | 0 |
| SP-376 | 9 | N1962 | 1.0E+07 | 0 | 0.95 | 0 |
| SP-376 | 10 | N1963 | 1.0E+07 | 40 | 0.81 | 2.6 |
| SP-376 | 11 | N1984 | 1.0E+08 | 0 | 0.97 | 0 |
| SP-376 | 12 | N1984 | 1.0E+07 | 0 | 0.90 | 1.1 |
| SP-376 | 13 | N1990 | 1.0E+08 | 0 | 0.92 | 1 |
| SP-376 | 14 | N1990 | 1.0E+07 | 0 | 0.92 | 1 |
| SP-376 | 15 | N1999 | 1.0E+08 | 10 | 0.87 | 1.4 |
| SP-376 | 16 | N1999 | 1.0E+07 | 0 | 0.93 | 0 |
| SP-376 | 17 | N1968 | 1.0E+07 | 50 | 0.78 | 3 |
| SP-376 | 18 | N1951 | 1.0E+07 | 0 | 0.93 | 1 |
| SP-376 | 19 | N1991 | 1.0E+07 | 0 | 0.93 | 1.1 |
| SP-376 | 20 | N1975 | 1.0E+07 | 50 | 0.78 | 3 |
| SP-376 | 21 | Naïve | | 0 | 0.99 | 0 |
| SP-383 | 1 | Vehicle Control | | 100 | 0.83 | 4 |
| SP-383 | 2 | 10% fecal suspension | | 0 | 0.92 | 0.1 |
| SP-383 | 9 | N1962 | 1.0E+09 | 10 | 0.95 | 1.3 |
| SP-383 | 10 | N1962 | 1.0E+08 | 10 | 0.93 | 1.3 |
| SP-383 | 11 | N1962 | 1.0E+07 | 0 | 0.92 | 1 |
| SP-383 | 12 | N1984 | 1.0E+09 | 0 | 0.89 | 1 |
| SP-383 | 13 | N1984 | 1.0E+08 | 10 | 0.94 | 1.3 |
| SP-383 | 14 | N1984 | 1.0E+07 | 10 | 0.90 | 1.3 |
| SP-383 | 21 | Naïve | | 0 | 1.00 | 0 |
| SP-390 | 1 | Vehicle Control | | 80 | 0.82 | 3.6 |
| SP-390 | 2 | 10% fecal suspension | | 0 | 0.98 | 0.1 |
| SP-390 | 3 | N1962 | 2.0E+07 | 0 | 0.97 | 0 |
| SP-390 | 4 | N1962 | 2.0E+06 | 0 | 0.98 | 0 |
| SP-390 | 5 | N1984 | 2.0E+07 | 0 | 0.95 | 1 |
| SP-390 | 6 | N1984 | 2.0E+06 | 0 | 0.95 | 0.1 |
| SP-390 | 9 | N1962 | 2.0E+07 | 0 | 0.93 | 1 |
| SP-390 | 10 | N1962 | 2.0E+06 | 10 | 0.93 | 1.3 |
| SP-390 | 11 | N1984 | 2.0E+07 | 20 | 0.86 | 2.2 |
| SP-390 | 12 | N1984 | 2.0E+09 | 30 | 0.88 | 2.1 |

TABLE 9-continued

| SP Expt. | SP Arm | Test Article | Target Dose (CFU/OTU/ mouse) | Cumulative Mortality (%) | Mean Min. Rel. Weight | Mean Max. Clin. Score (Death = 4) |
|---|---|---|---|---|---|---|
| SP-390 | 13 | N1952 | 2.0E+07 | 0 | 0.89 | 1 |
| SP-390 | 14 | N2001 | 2.0E+07 | 0 | 0.95 | 0.2 |
| SP-390 | 15 | N1973 | 2.0E+07 | 10 | 0.90 | 0.7 |
| SP-390 | 16 | N1954 | 2.0E+07 | 0 | 0.94 | 1.1 |
| SP-390 | 17 | N1985 | 2.0E+07 | 10 | 0.86 | 1.8 |
| SP-390 | 18 | N1971 | 2.0E+07 | 0 | 0.89 | 0.9 |
| SP-390 | 19 | N1956 | 2.0E+07 | 0 | 0.95 | 0 |
| SP-390 | 20 | N1992 | 2.0E+07 | 0 | 0.95 | 0 |
| SP-390 | 31 | Naïve |  | 0 | 0.98 | 0 |

TABLE 10

| Network Ecology ID | Exemplary Network Clades | Exemplary Network OTUs |
|---|---|---|
| N306 | clade_252, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_38 or clade_38e or clade_38i), (clade_408 or clade_408b or clade_408d or clade_408f or clade_408g or clade_408h), (clade_444 or clade_444i), (clade_478 or clade_478i), (clade_481 or clade_481a or clade_481b or clade_481e or clade_481g or clade_481h or clade_481i), clade_494, (clade_553 or clade_553i) | *Blautia producta, Clostridium hylemonae, Clostridium innocuum, Clostridium orbiscindens, Clostridium symbiosum, Clostridium tertium, Collinsella aerofaciens, Coprobacillus* sp. D7, *Coprococcus comes, Eubacterium rectale, Eubacterium* sp. WAL 14571, *Faecalibacterium prausnitzii,* Lachnospiraceae bacterium 5_1_57FAA, *Roseburia faecalis, Ruminococcus obeum, Ruminococcus torques* |
| N382 | clade_252, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia producta, Clostridium hylemonae, Clostridium innocuum, Clostridium orbiscindens, Clostridium symbiosum, Clostridium tertium, Collinsella aerofaciens, Coprococcus comes,* Lachnospiraceae bacterium 5_1_57FAA, *Ruminococcus bromii, Ruminococcus gnavus* |
| N402 | (clade_262 or clade_262i), clade_286, (clade_309 or clade_309c or clade_309e or clade_309g or clade_309h or clade_309i), (clade_360 or clade_360c or clade_360g or clade_360h or clade_360i), (clade_444 or clade_444i), clade_466, (clade_478 or clade_478i), clade_500 | *Alistipes shahii, Coprococcus comes, Dorea formicigenerans, Dorea longicatena, Eubacterium rectale, Faecalibacterium prausnitzii, Odoribacter splanchnicus, Parabacteroides merdae, Ruminococcus obeum, Ruminococcus torques* |
| N414 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), clade_466, (clade_478 or clade_478i), (clade_522 or clade_522i) | *Coprococcus comes, Dorea formicigenerans, Dorea longicatena, Eubacterium eligens, Eubacterium rectale, Faecalibacterium prausnitzii, Odoribacter splanchnicus, Ruminococcus obeum, Ruminococcus torques* |
| N435 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), clade_466, (clade_478 or clade_478i) | *Coprococcus comes, Dorea formicigenerans, Dorea longicatena, Eubacterium rectale, Faecalibacterium prausnitzii, Odoribacter splanchnicus, Ruminococcus obeum, Ruminococcus torques* |
| N457 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i), (clade_522 or clade_522i) | *Dorea longicatena, Eubacterium eligens, Eubacterium rectale, Faecalibacterium prausnitzii, Roseburia intestinalis, Ruminococcus obeum, Ruminococcus torques* |
| N460 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), clade_466, (clade_478 or clade_478i) | *Coprococcus comes, Dorea formicigenerans, Eubacterium rectale, Faecalibacterium prausnitzii, Odoribacter splanchnicus, Ruminococcus obeum, Ruminococcus torques* |

TABLE 10-continued

| Network Ecology ID | Exemplary Network Clades | Exemplary Network OTUs |
|---|---|---|
| N461 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i) | Coprococcus comes, Dorea formicigenerans, Dorea longicatena, Eubacterium rectale, Faecalibacterium prausnitzii, Ruminococcus obeum, Ruminococcus torques |
| N510 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i), (clade_522 or clade_522i) | Dorea longicatena, Eubacterium eligens, Eubacterium rectale, Faecalibacterium prausnitzii, Ruminococcus obeum, Ruminococcus torques |
| N511 | (clade_262 or clade_262i), (clade_309 or clade_309c or clade_309e or clade_309g or clade_309h or clade_309i), (clade_444 or clade_444i), (clade_478 or clade_478i) | Coprococcus comes, Eubacterium rectale, Faecalibacterium prausnitzii, Roseburia intestinalis, Ruminococcus obeum, Ruminococcus torques |
| N512 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i) | Coprococcus comes, Dorea formicigenerans, Dorea longicatena, Eubacterium rectale, Ruminococcus obeum, Ruminococcus torques |
| N513 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i) | Coprococcus comes, Dorea formicigenerans, Eubacterium rectale, Faecalibacterium prausnitzii, Ruminococcus obeum, Ruminococcus torques |
| N571 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i) | Dorea longicatena, Eubacterium rectale, Faecalibacterium prausnitzii, Ruminococcus obeum, Ruminococcus torques |
| N582 | (clade_262 or clade_262i), (clade_309 or clade_309c or clade_309e or clade_309g or clade_309h or clade_309i), (clade_408 or clade_408b or clade_408d or clade_408f or clade_408g or clade_408h), (clade_444 or clade_444i), (clade_478 or clade_478i) | Clostridium symbiosum, Eubacterium rectale, Faecalibacterium prausnitzii, Ruminococcus obeum, Ruminococcus torques |
| N584 | (clade_260 or clade_260c or clade_260g or clade_260h), (clade_262 or clade_262i), (clade_309 or clade_309c or clade_309e or clade_309g or clade_309h or clade_309i), (clade_408 or clade_408b or clade_408d or clade_408f or clade_408g or clade_408h), (clade_553 or clade_553i) | Blautia producta, Clostridium symbiosum, Collinsella aerofaciens, Coprococcus comes, Lachnospiraceae bacterium 5_1_57FAA |
| N603 | (clade_172 or clade_172i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i) | Bifidobacterium adolescentis, Dorea longicatena, Eubacterium rectale, Faecalibacterium prausnitzii, Ruminococcus obeum |
| N682 | clade_170, (clade_309 or clade_309c or clade_309e or clade_309g or clade_309h or clade_309i), (clade_444 or clade_444i), (clade_478 or clade_478i) | Bacteroides caccae, Eubacterium rectale, Faecalibacterium prausnitzii, Ruminococcus obeum |
| N732 | (clade_262 or clade_262i), (clade_309 or clade_309c or clade_309e or clade_309g or clade_309h or clade_309i), (clade_478 or clade_478i) | Coprococcus comes, Faecalibacterium prausnitzii, Ruminococcus obeum, Ruminococcus torques |
| N736 | (clade_262 or clade_262i), (clade_309 or clade_309c or clade_309e or clade_309g or clade_309h or clade_309i), (clade_360 or clade_360c or clade_360g or clade_360h or clade_360i), (clade_478 or clade_478i) | Dorea longicatena, Faecalibacterium prausnitzii, Ruminococcus obeum, Ruminococcus torques |
| N853 | (clade_262 or clade_262i), (clade_444 or clade_444i), (clade_478 or clade_478i) | Eubacterium rectale, Faecalibacterium prausnitzii, Ruminococcus torques |
| N861 | (clade_262 or clade_262i), (clade_309 or clade_309c or clade_309e or clade_309g or clade_309h or clade_309i), (clade_408 or clade_408b or clade_408d or clade_408f or clade_408g or clade_408h) | Clostridium hathewayi, Ruminococcus obeum, Ruminococcus torques |
| N879 | (clade_309 or clade_309c or clade_309e or clade_309g or clade_309h or clade_309i), (clade_444 or clade_444i), (clade_478 or clade_478i) | Faecalibacterium prausnitzii, Roseburia intestinalis, Ruminococcus obeum |

TABLE 10-continued

| Network Ecology ID | Exemplary Network Clades | Exemplary Network OTUs |
|---|---|---|
| N975 | clade_170, (clade_262 or clade_262i), (clade_360 or clade_360c or clade_360g or clade_360h clade_360i) | *Bacteroides caccae, Coprococcus comes, Dorea longicatena* |
| N999 | (clade_309 or clade_309c or clade_309e or clade_309g or clade_309h or clade_309i), (clade_360 or clade_360c or clade_360g or clade_360h or clade_360i), (clade_478 or clade_478i) | *Dorea formicigenerans, Faecalibacterium prausnitzii, Ruminococcus obeum* |
| N1095 | (clade_444 or clade_444i), (clade_522 or clade_522i) | *Eubacterium eligens, Eubacterium rectale* |
| N1947 | (clade_262 or clade_262i), (clade_309 or clade_309c or clade_309e or clade_309g or clade_309h or clade_309i), (clade_360 or clade_360c or clade_360g or clade_360h or clade_360i), (clade_38 or clade_38e or clade_38i), (clade_444 or clade_444i), (clade_478 or clade_478i), (clade_553 or clade_553i), (clade_92 or clade_92e or clade_92i) | *Bacteroides* sp. 3_1_23, *Collinsella aerofaciens, Dorea longicatena, Escherichia coli, Eubacterium rectale, Faecalibacterium prausnitzii, Roseburia intestinalis, Ruminococcus obeum, Ruminococcus torques* |
| N1948 | (clade_262 or clade_262i), (clade_38 or clade_38e or clade_38i), (clade_478 or clade_478i), (clade_65 or clade_65e) | *Bacteroides* sp. 1_1_6, *Bacteroides* sp. 3_1_23, *Faecalibacterium prausnitzii, Ruminococcus torques* |
| N1949 | (clade_309 or clade_309c or clade_309e or clade_309g or clade_309h or clade_309i), (clade_378 or clade_378e), (clade_38 or clade_38e or clade_38i), (clade_479 or clade_479c or clade_479g or clade_479h), (clade_497 or clade_497e or clade_497f), (clade_65 or clade_65e), (clade_92 or clade_92e or clade_92i) | *Bacteroides* sp. 1_1_6, *Bacteroides* sp. 3_1_23, *Bacteroides vulgatus, Blautia producta, Enterococcus faecalis,* Erysipelotrichaceae bacterium 3_1_53, *Escherichia coli* |
| N1950 | clade_253, (clade_309 or clade_309c or clade_309e or clade_309g or clade_309h or clade_309i), (clade_378 or clade_378e), (clade_38 or clade_38e or clade_38i), (clade_479 or clade_479c or clade_479g or clade_479h), (clade_65 or clade_65e) | *Bacteroides* sp. 1_1_6, *Bacteroides* sp. 3_1_23, *Bacteroides vulgatus, Blautia producta, Clostridium disporicum,* Erysipelotrichaceae bacterium 3_1_53 |
| N1951 | (clade_260 or clade_260c or clade_260g or clade_260h), (clade_262 or clade_262i), (clade_309 or clade_309c or clade_309e or clade_309g or clade_309h or clade_309i), (clade_360 or clade_360c or clade_360g or clade_360h or clade_360i), (clade_408 or clade_408b or clade_408d or clade_408f or clade_408g or clade_408h), (clade_444 or clade_444i) | *Blautia producta, Clostridium bolteae, Clostridium hylemonae, Clostridium symbiosum, Coprococcus comes, Eubacterium rectale,* Lachnospiraceae bacterium 5_1_57FAA, *Ruminococcus gnavus* |
| N1952 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_354 or clade_354e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia producta, Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Collinsella aerofaciens, Coprococcus comes,* Lachnospiraceae bacterium 5_1_57FAA, *Ruminococcus bromii, Ruminococcus gnavus* |
| N1953 | clade_253, (clade_262 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_378 or clade_378e), (clade_408 or clade_408b or clade_408d or clade_408f or clade_408g or clade_408h), (clade_444 or clade_444i), clade_466, (clade_478 or clade_478i), (clade_479 or clade_479c or clade_479g or clade_479h), (clade_481 or clade_481a or clade_481b or clade_481e or clade_481g or clade_481h or clade_481i), (clade_497 or clade_497e or clade_497f), (clade_65 or clade_65e), (clade_92 or clade_92e or clade_92i) | *Bacteroides* sp. 1_1_6, *Bacteroides vulgatus, Clostridium disporicum, Clostridium mayombei, Clostridium symbiosum, Coprobacillus* sp. D7, *Coprococcus comes, Dorea formicigenerans, Enterococcus faecalis,* Erysipelotrichaceae bacterium 3_1_53, *Escherichia coli, Eubacterium rectale, Faecalibacterium prausnitzii, Odoribacter splanchnicus, Ruminococcus obeum* |
| N1954 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or | *Blautia* sp. M25, *Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Collinsella* |

TABLE 10-continued

| Network Ecology ID | Exemplary Network Clades | Exemplary Network OTUs |
|---|---|---|
| | clade__351e), (clade__354 or clade__354e), (clade__360 or clade__360c or clade__360g or clade__360h or clade__360i), (clade__408 or clade__408b or clade__408d or clade__408f or clade__408g or clade__408h), clade__494, clade__537, (clade__553 or clade__553i) | aerofaciens, Coprococcus comes, Lachnospiraceae bacterium 5_1_57FAA, Ruminococcus bromii, Ruminococcus gnavus |
| N1955 | (clade__309 or clade__309c or clade__309e or clade__309g or clade__309h or clade__309i), (clade__354 or clade__354e), (clade__378 or clade__378e), (clade__38 or clade__38e or clade__38i), (clade__479 or clade__479c or clade__479g or clade__479h), (clade__481 or clade__481a or clade__481b or clade__481e or clade__481g or clade__481h or clade__481i), (clade__497 or clade__497e or clade__497f), (clade__65 or clade__65e), (clade__92 or clade__92e or clade__92i) | Bacteroides sp. 1_1_6, Bacteroides sp. 2_1_22, Bacteroides sp. 3_1_23, Bacteroides vulgatus, Blautia producta, Clostridium sordellii, Coprobacillus sp. D7, Enterococcus faecalis, Enterococcus faecium, Erysipelotrichaceae bacterium 3_1_53, Escherichia coli |
| N1956 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__354 or clade__354e), (clade__360 or clade__360c or clade__360g or clade__360h or clade__380i), (clade__408 or clade__408b or clade__408d or clade__408f or clade__408g or clade__408h), clade__494, clade__537, (clade__553 or clade__553i) | Blautia producta, Clostridium bolteae, Clostridium butyricum, Clostridium disporicum, Clostridium hylemonae, Clostridium innocuum, Clostridium mayombei, Clostridium nexile, Clostridium orbiscindens, Clostridium symbiosum, Clostridium tertium, Collinsella aerofaciens, Lachnospiraceae bacterium 5_1_57FAA, Ruminococcus bromii, Ruminococcus gnavus |
| N1957 | (clade__309 or clade__309c or clade__309e or clade__309g or clade__309h or clade__309i), (clade__351 or clade__351e), (clade__354 or clade__354e), (clade__378 or clade__378e), (clade__38 or clade__38e or clade__38i), (clade__481 or clade__481a or clade__481b or clade__481e or clade__481g or clade__481h or clade__481i), (clade__497 or clade__497e or clade__497f), (clade__65 or clade__65e), (clade__92 or clade__92e or clade__92i) | Bacteroides sp. 1_1_6, Bacteroides sp. 3_1_23, Bacteroides vulgatus, Blautia producta, Clostridium innocuum, Clostridium sordellii, Coprobacillus sp. D7, Enterococcus faecalis, Escherichia coli |
| N1958 | (clade__351 or clade__351e), (clade__354 or clade__354e), (clade__481 or clade__481a or clade__481b or clade__481e or clade__481g or clade__481h or clade__481i) | Clostridium innocuum, Clostridium sordellii, Coprobacillus sp. D7 |
| N1959 | clade__253, (clade__262 or clade__262i), (clade__309 or clade__309c or clade__309e or clade__309g or clade__309h or clade__309i), (clade__360 or clade__360c or clade__360g or clade__360h or clade__360i), (clade__378 or clade__378e), (clade__38 or clade__38e or clade__38i), (clade__444 or clade__444i), (clade__478 or clade__478i), (clade__479 or clade__479c or clade__479g or clade__479h), (clade__497 or clade__497e or clade__497f), (clade__522 or clade__522i), (clade__65 or clade__65e), (clade__92 or clade__92e or clade__92i) | Bacteroides sp. 1_1_6, Bacteroides sp. 3_1_23, Bacteroides vulgatus, Blautia producta, Clostridium disporicum, Coprococcus comes, Dorea formicigenerans, Dorea longicatena, Enterococcus faecalis, Erysipelotrichaceae bacterium 3_1_53, Escherichia coli, Eubacterium eligens, Eubacterium rectale, Faecalibacterium prausnitzii, Ruminococcus obeum, Ruminococcus torques |
| N1960 | clade__253, (clade__262 or clade__262i), (clade__309 or clade__309c or clade__309e or clade__309g or clade__309h or clade__309i), (clade__354 or clade__354e), (clade__360 or clade__360c or clade__360g or clade__360h or clade__360i), (clade__408 or clade__408b or clade__408d or clade__408f or clade__408g or clade__408h), (clade__444 or clade__444i), (clade__478 or clade__478i), (clade__479 or clade__479c or clade__479g or clade__479h), (clade__481 or clade__481a or clade__481b or clade__481e or clade__481g or clade__481h or clade__481i), (clade__497 or clade__497e or clade__497f), (clade__92 or clade__92e or clade__92i) | Clostridium disporicum, Clostridium mayombei, Clostridium symbiosum, Coprobacillus sp. D7, Coprococcus comes, Dorea formicigenerans, Enterococcus faecalis, Erysipelotrichaceae bacterium 3_1_53, Escherichia coli, Eubacterium rectale, Faecalibacterium prausnitzii, Ruminococcus obeum |
| N1961 | (clade__309 or clade__309c or clade__309e or clade__309g or clade__309h or clade__309i), (clade__351 or clade__351e), (clade__378 or clade__378e), (clade__38 or clade__38e or clade__38i), (clade__497 or clade__497e or clade__497f), (clade__65 or clade__65e), (clade__92 or clade__92e or clade__92i) | Bacteroides sp. 1_1_6, Bacteroides sp. 3_1_23, Bacteroides vulgatus, Blautia producta, Clostridium innocuum, Enterococcus faecalis, Escherichia coli |

TABLE 10-continued

| Network Ecology ID | Exemplary Network Clades | Exemplary Network OTUs |
|---|---|---|
| N1962 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_354 or clade_354e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia producta, Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Collinsella aerofaciens, Coprococcus comes,* Lachnospiraceae bacterium 5_1_S7FAA, *Ruminococcus bromii, Ruminococcus gnavus* |
| N1963 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia producta, Clostridium disporicum, Clostridium hylemonae, Clostridium innocuum, Clostridium orbiscindens, Clostridium symbiosum, Clostridium tertium, Collinsella aerofaciens, Coprococcus comes,* Lachnospiraceae bacterium 5_1_57FAA, *Ruminococcus bromii, Ruminococcus gnavus* |
| N1964 | clade_170, (clade_260 or clade_260c or clade_260g or clade_260h), (clade_262 or clade_262i), clade_286, (clade_309 or clade_309c or clade_309e or clade_309g or clade_309h or clade_309i), (clade 360 or clade_360c or clade_360g or clade_360h or clade_360i), (clade_408 or clade_408b or clade_408d or clade_408f or clade_408g or clade_408h), (clade_444 or clade_444i), clade_485, clade_500, clade_537, (clade_553 or clade_553i), clade_85 | *Alistipes shahii, Bacteroides caccae, Bacteroides stercoris, Blautia producta, Clostridium hathewayi, Clostridium symbiosum, Collinsella aerofaciens, Coprococcus comes, Dorea formicigenerans, Eubacterium rectale, Holdemania filiformis,* Lachnospiraceae bacterium 5_1_57FAA, *Parabacteroides merdae, Ruminococcus bromii, Ruminococcus obeum, Ruminococcus torques* |
| N1965 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_354 or clade_354e), (clade_408 or clade_408b or clade_408d or clade_408f or clade_408g or clade_408h), (clade_444 or clade_444i), (clade_478 or clade_478i), clade_537, (clade_553 or clade_553i) | *Blautia products, Clostridium bolteae, Clostridium butyricum, Clostridium disporicum, Clostridium mayombel, Clostridium symbiosum, Collinsella aerofaciens, Coprococcus comes, Eubacterium rectale, Faecalibacterium prausnitzii,* Lachnospiraceae bacterium 5_1_57FAA, *Roseburia intestinalis, Ruminococcus bromii, Ruminococcus obeum* |
| N1966 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_354 or clade_354e), (clade_408 or clade_408b or clade_408d or clade_408f or clade_408g or clade_408h), (clade_553 or clade_553i) | *Blautia producta, Clostridium bolteae, Clostridium butyricum, Clostridium disporicum, Clostridium mayombei, Clostridium symbiosum, Collinsella aerofaciens, Coprococcus comes,* Lachnospiraceae bacterium 5_1_57FAA |
| N1967 | (clade_309 or clade_309c or clade_309e or clade_309g or clade_309h or clade_309i), (clade_378 or clade_378e), (clade_38 or clade_38e or clade_38i), (clade_497 or clade_497e or clade_497f), (clade_65 or clade_65e), (clade_92 or clade_92e or clade_92i) | *Bacteroides* sp. 1_1_6, *Bacteroides* sp. 3_1_23, *Bacteroides vulgatus, Blautia producta, Enterococcus faecium, Escherichia coli* |
| N1968 | clade_252, clade_253, (clade_351 or clade_351e), (clade_354 or clade_354e), (clade_478 or clade_478i), clade_494, clade_537, (clade_553 or clade_553i) | *Clostridium butyricum, Clostridium disporicum, Clostridium innocuum, Clostridium mayombei, Clostridium orbiscindens, Clostridium tertium, Collinsella aerofaciens, Faecalibacterium prausnitzii, Ruminococcus bromii* |
| N1969 | clade_252, clade_253, (clade_262 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_479 or clade_479c or clade_479g or clade_479h) | *Blautia producta, Clostridium butyricum, Clostridium disporicum, Clostridium mayombei, Dorea formicigenerans,* Erysipelotrichaceae bacterium 3_1_53, *Ruminococcus torques* |

TABLE 10-continued

| Network Ecology ID | Exemplary Network Clades | Exemplary Network OTUs |
|---|---|---|
| N1970 | (clade__351 or clade__351e), (clade__354 or clade__354e), (clade__378 or clade__378e), (clade__38 or clade__38e or clade__38i), (clade__481 or clade__481a or clade__481b or clade__481e or clade__481g or clade__481h or clade__481i), (clade__497 or clade__497e or clade__497f), (cladc__65 or clade__65e), (clade__92 or clade__92e or clade__92i) | Bacteroides sp. 1__1__6, Bacteroides sp. 3__1__23, Bacteroides vulgatus, Clostridium innocuum, Clostridium sordellii, Coprobacillus sp. D7, Enterococcus faecalis, Escherichia coli |
| N1971 | clade__252, clade__253, (clade__260 or clade__260c or clade__260g or clade__260h), (clade__262 or clade__262i), (clade__351 or clade__351e), (clade__354 or clade__354e), (clade__360 or clade__360c or clade__360g or clade__360h or clade__360i), (clade__408 or clade__408b or clade__408d or clade__408f or clade__408g or clade__408h), clade__494, clade__537, (clade__553 or clade__553i) | Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Collinsessa aerofaciens, Coprococcus comes, Lachnospiraceae bacterium 5__1__57FAA, Ruminococcus bromii, Ruminococcus gnavus |
| N1972 | clade__253, (clade__262 or clade__262i), (clade__309 or clade__309c or clade__309e or clade__309g or clade__309h or clade__309i), (clade__354 or clade__354e), (clade__360 or clade__360c or clade__360g or clade__360h or clade__360i), (clade__408 or clade__408b or clade__408d or clade__408f or clade__408g or clade__408h), (clade__444 or clade__444i), (clade__478 or clade__478i), (clade__479 or clade__479c or clade__479g or clade__479h), (clade__481 or clade__481a or clade__481b or clade__481e or clade__481g or clade__481h or clade__481i) | Clostridium disporicum, Clostridium mayombei, Clostridium symbiosum, Coprobacillus sp. D7, Coprococcus comes, Dorea formicigenerans, Erysipelotrichaceae bacterium 3__1__53, Eubacterium rectale, Faecalibacterium prausnitzii, Ruminococcus obeum |
| N1973 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__354 or clade__354e), (clade__360 or clade__360c or clade__360g or clade__360h or clade__360i), (clade__408 or clade__408b or clade__408d or clade__408f or clade__408g or clade__408h), clade__494, clade__537 | Blautia producta, Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Coprococcus comes, Lachnospiraceae bacterium 5__1__57FAA, Ruminococcus bromii, Ruminococcus gnavus |
| N1974 | (clade__262 or clade__262i), (clade__309 or clade__309c or clade__309e or clade__309g or clade__309h or clade__309f), (clade__360 or clade__360c or clade__360g or clade__360h or clade__360i), (clade__444 or clade__444i), clade__466, (clade__478 or clade__478i) | Coprococcus comes, Dorea formicigenerans, Dorea longicatena, Eubacterium rectale, Faecalibacterium prausnitzii, Odoribacter splanchnicus, Roseburia intestinalis, Ruminococcus obeum, Ruminococcus torques |
| N1975 | (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__354 or clade__354e), (clade__360 or clade__360c or clade__360g or clade__360h or clade__360i), (clade__408 or clade__408b or clade__408d or clade__408f or clade__408g or clade__408h), (clade__444 or clade__444i), (clade__478 or clade__478i), clade__494, clade__537, (clade__553 or clade__553i) | Blautia producta, Clostridium bolteae, Clostridium hylemonae, Clostridium innocuum, Clostridium mayombei, Clostridium orbiscindens, Clostridium symbiosum, Collinsella aerofaciens, Coprococcus comes, Eubacterium rectale, Faecalibacterium prausnitzii, Lachnospiraceae bacterium 5__1__57FAA, Ruminococcus bromii, Ruminococcus gnavus |
| N1976 | (clade__351 or clade__351e), (clade__378 or clade__378e), (clade__38 or clade__38e or clade__38i), (clade__481 or clade__481a or clade__481b or clade__481e or clade__481g or clade__481h or clade__481i), (clade__497 or clade__497e or clade__497f), (clade__65 or clade__65e) | Bacteroides sp. 1__1__6, Bacteroides sp. 3__1__23, Bacteroides vulgatus, Clostridium innocuum, Coprobacillus sp. D7, Enterococcus faecalis |
| N1977 | clade__252, clade__253, (clade__262 or clade__262i), (clade__309 or clade__309c or clade__309e or clade__309g or clade__309h or clade__309i), (clade__354 or clade__354e), (clade__360 or clade__360c or clade__360g or clade__360h or clade__360i), (clade__479 or clade__479c or clade__479g or clade__479h) | Blautia producta, Clostridium butyricum, Clostridium disporicum, Clostridium mayombei, Dorea formicigenerans, Erysipelotrichaceae bacterium 3__1__53, Eubacterium tenue, Ruminococcus torques |
| N1978 | clade__253, (clade__262 or clade__262i), (clade__309 or clade__309c or clade__309e or clade__309g or clade__309h or clade__309i), (clade__354 or clade__354e), (clade__360 or | Bacteroides sp. 1__1__6, Bacteroides vulgatus, Clostridium disporicum, Clostridium mayombei, Clostridium symbiosum, Coprobacillus sp. D7, Coprococcus comes, Dorea formicigenerans, |

TABLE 10-continued

| Network Ecology ID | Exemplary Network Clades | Exemplary Network OTUs |
|---|---|---|
| | clade_360c or clade_360g or clade_360h or clade_360i), (clade_378 or clade_378e), (clade_408 or clade_408b or clade_408d or clade_408f or clade_408g or clade_408h), (clade_444 or clade_444i), clade_466, (clade_478 or clade_478i), (clade_479 or clade_479c or clade_479g or clade_479h), (clade_481 or clade_481a or clade_481b or clade_481e or clade_481g or clade_481h or clade_481i), (clade_65 or clade_65e), (clade_92 or clade_92e or clade_92i) | Erysipelotrichaceae bacterium 3_1_53, *Escherichia coli, Eubacterium rectale, Faecalibacterium prausnitzii, Odoribacter splanchnicus, Ruminococcus obeum* |
| N1979 | (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i), (clade_65 or clade_65e) | *Bacteroides* sp. 1_1_6, *Coprococcus comes, Dorea formicigenerans, Dorea longicatena, Eubacterium rectale, Faecalibacterium prausnitzii, Ruminococcus obeum, Ruminococcus torques* |
| N1980 | (clade_309 or clade_309c or clade_309e or clade_309g or clade_309h or clade_309i), (clade_351 or clade_351e), (clade_354 or clade_354e), (clade_481 or clade_481a or clade_481b or clade_481e or clade_481g or clade_481h or clade_481i), (clade_497 or clade_497e or clade_497f), (clade_92 or clade_92e or clade_92i) | *Blautia producta, Clostridium innocuum, Clostridium sordellii, Coprobacillus* sp. D7, *Enterococcus faecalis, Escherichia coli* |
| N1981 | (clade_262 or clade_262i), (clade_309 or clade_309c or clade_309e or clade_309g or clade_309h or clade_309i), (clade_360 or clade_360c or clade_360g or clade_360h or clade_360i), (clade_38 or clade_38e or clade_38i), (clade_444 or clade_444i), (clade_478 or clade_478i), (clade_522 or clade_522i) | *Bacteroides* sp. 3_1_23, *Dorea longicatena, Eubacterium eligens, Eubacterium rectale, Faecalibacterium prausnitzii, Ruminococcus obeum, Ruminococcus torques* |
| N1982 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_408 or clade_408b or clade_408d or clade_408f or clade_408g or clade_408h), (clade_444 or clade_444i), (clade_479 or clade_479c or clade_479g or clade_479h), (clade_553 or clade_553i) | *Blautia producta, Clostridium bolteae, Clostridium butyricum, Clostridium disporicum, Clostridium mayombei, Clostridium symbiosum, Collinsella aerofaciens, Coprococcus comes, Dorea formicigenerans,* Erysipelotrichaceae bacterium 3_1_53, *Eubacterium rectale,* Lachnospiraceae bacterium 5_1_57FAA, *Ruminococcus obeum, Ruminococcus torques* |
| N1983 | clade_252, clade_253, (clade_309 or clade_309c or clade_309e or clade_309g or clade_309h or clade_309i), (clade_354 or clade_354e), (clade_378 or clade_378e), (clade_38 or clade_38e or clade_38i), (clade_479 or clade_479c or clade_479g or clade_479h), (clade_497 or clade_497e or clade_497f), (clade_65 or clade_65e), (clade_92 or clade_92e or clade_92i) | *Bacteroides* sp. 1_1_6, *Bacteroides* sp. 3_1_23, *Bacteroides vulgatus, Blautia producta, Clostridium butyricum, Clostridium disporicum, Clostridium mayombei, Enterococcus faecium,* Erysipelotrichaceae bacterium 3_1_53, *Escherichia coli* |
| N1984 | clade_253, (clade_260 or clade_260c or clade_260g or clade_260h), (clade_309 or clade_309c or clade_309e or clade_309g or clade_309h or clade_309i), (clade_351 or clade_351e), (clade_354 or clade_354e), (clade_403 or clade_408b or clade_408d or clade_408f or clade_408g or clade_408h), (clade_444 or clade_444i), clade_494, (clade_553 or clade_553i) | *Blautia producta, Clostridium disporicum, Clostridium innocuum, Clostridium mayombei, Clostridium orbiscindens, Clostridium symbiosum, Collinsella aerofaciens, Eubacterium rectale,* Lachnospiraceae bacterium 5_1_57FAA |
| N1985 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_354 or clade_354e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia glucerasei, Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertiurm, Collinsella aerofaciens, Coprococcus comes,* Lachnospiraceae bacterium 5_1_57FAA, *Ruminococcus bromii, Ruminococcus gnavus* |
| N1986 | clade_253, (clade_260 or clade_260c or clade_260g or clade_260h), (clade_262 or | *Blautia producta, Clostridium disporicum, Clostridium symbiosum, Collinsella aerofaciens,* |

TABLE 10-continued

| Network Ecology ID | Exemplary Network Clades | Exemplary Network OTUs |
|---|---|---|
| | clade__262i), (clade__309 or clade__309c or clade__309e or clade__309g or clade__309h or clade__309i), (clade__408 or clade__408b or clade__408d or clade__408f or clade__408g or clade__408h), (clade__553 or clade__553i) | *Coprococcus comes*, Lachnospiraceae bacterium 5_1_57FAA |
| N1987 | (clade__309 or clade__309c or clade__309e or clade__309g or clade__309h or clade__309i), (clade__354 or clade__354e), (clade__92 or clade__92e or clade__92i) | *Blautia producta, Clostridium sordellii, Escherichia coli* |
| N1988 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__354 or clade__354e), (clade__408 or clade__408b or clade__408d or clade__408f or clade__408g or clade__408h), (clade__444 or clade__444i), (clade__478 or clade__478i), clade__485, clade__500, (clade__553 or clade__553i) | *Alistipes shahii, Blautia producta, Clostridium bolteae, Clostridium butyricum, Clostridium disporicum, Clostridium mayombei, Clostridium symbiosum, Collinsella aerofaciens, Coprococcus comes, Eubacterium rectale, Faecalibacterium prausnitzii, Holdemania filiformis,* Lachnospiraceae bacterium 5_1_57FAA, *Roseburia intestinalis, Ruminococcus obeum, Ruminococcus torques* |
| N1989 | clade__252, clade__253, (clade__262 or clade__262i), (clade__309 or clade__309c or clade__309e or clade__309g or clade__309h or clade__309i), (clade__354 or clade__354e), (clade__360 or clade__360c or clade__360g or clade__360h or clade__360i), (clade__378 or clade__378e), (clade__38 or clade__38e or clade__38i), (clade__479 or clade__479c or clade__479g or clade__479h), (clade__497 or clade__497e or clade__497f), (clade__65 or clade__65e), (clade__92 or clade__92e or clade__92i) | *Bacteroides* sp. 1_1_6, *Bacteroides* sp. 3_1_23, *Bacteroides vulgatus, Blautia producta, Clostridium butyricum, Clostridium disporicum, Clostridium mayombei, Dorea formicigenerans, Enterococcus faecium,* Erysipelotrichaceae bacterium 3_1_53, *Escherichia coli, Eubacterium tenue, Ruminococcus torques* |
| N1990 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__360 or clade__360c or clade__360g or clade__360h or clade__360i), (clade__408 or clade__408b or clade__408d or clade__408f or clade__408g or clade__408h), (clade__444 or clade__444i), (clade__478 or clade__478i), clade__494, clade__537, (clade__553 or clade__553i) | *Blautia producta, Clostridium disporicum, Clostridium hylemonae, Clostridium innocuum, Clostridium orbiscindens, Clostridium symbiosum, Clostridium tertium, Collinsella aerofaciens, Coprococcus comes, Eubacterium rectale, Faecalibacterium prausnitzii,* Lachnospiraceae bacterium 5_1_57FAA, *Ruminococcus bromii, Ruminococcus gnavus* |
| N1991 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__354 or clade__354e), (clade__360 or clade__360c or clade__360g or clade__360h or clade__360i), (clade__408 or clade__408b or clade__408d or clade__408f or clade__408g or clade__408h), (clade__444 or clade__444i), (clade__553 or clade__553i) | *Blautia producta, Clostridium bolteae, Clostridium butyricum, Clostrtdium disporicum, Clostridium hylemonae, Clostridium innocuum, Clostridium mayombei, Clostridium symbiosum, Clostridium tertium, Collinsella aerofaciens, Coprococcus comes, Eubacterium rectale,* Lachnospiraceae bacterium 5_1_57FAA, *Ruminococcus gnavus* |
| N1992 | clade__252, clade__253, (clade__260 or clade__260c or clade__260g or clade__260h), (clade__262 or clade__262i), (clade__309 or clade__309c or clade__309e or clade__309g or clade__309h or clade__309i), (clade__351 or clade__351e), (clade__354 or clade__354e), (clade__360 or clade__360c or clade__360g or clade__360h or clade__360i), (clade__408 or clade__408b or clade__408d or clade__408f or clade__408g or clade__408h), clade__494, clade__537, (clade__553 or clade__553i) | *Blautia producta, Clostridium bolteae, Clostridium butyricum, Clostridium disporicum, Clostridium hylemonae, Clostridium innocuum, Clostridium mayombei, Clostridium orbiscindens, Clostridium symbiosum, Clostridium tertium, Collinsella aerofaciens,* Lachnospiraceae bacterium 1_4_56FAA, Lachnospiraceae bacterium 5_1_57FAA, *Ruminococcus bromii, Ruminococcus gnavus* |
| N1993 | clade__110, clade__170, (clade__378 or clade__378e), (clade__38 or clade__38e or clade__38i), (clade__65 or clade__65e), clade__85 | *Bacteroides caccae, Bacteroides eggerthii, Bacteroides* sp. 1_1_6, *Bacteroides* sp. 3_1_23, *Bacteroides stercoris, Bacteroides uniformis, Bacteroides vulgatus* |
| N1994 | clade__253, (clade__378 or clade__378e), (clade__38 or clade__38e or clade__38i), (clade__479 or clade__479c or clade__479g or clade__479h), (clade__497 or clade__497e or clade__497f), (clade__65 or clade__65e), (clade__92 or clade__92e or clade__92i) | *Bacteroides* sp. 1_1_6, *Bacteroides* sp. 3_1_23, *Bacteroides vulgatus, Clostridium disporicum, Enterococcus faecium,* Erysipelotrichaceae bacterium 3_1_53, *Escherichia coli* |
| N1995 | clade__253, (clade__309 or clade__309c or clade__309e or clade__309g or clade__309h or | *Bacteroides* sp. 1_1_6, *Bacteroides* sp. 3_1_23, *Bacteroides vulgatus, Blautia producta, Clostridium* |

TABLE 10-continued

| Network Ecology ID | Exemplary Network Clades | Exemplary Network OTUs |
|---|---|---|
| | clade_309i), (clade_378 or clade_378e), (clade_38 or clade_38e or clade_38i), (clade_479 or clade_479c or clade_479g or clade_479h), (clade_497 or clade_497e or clade_497f), (clade_65 or clade_65e), (clade_92 or clade_92e or clade_92i) | *disporicum, Enterococcus faecium,* Erysipelotrichaceae bacterium 3_1_53, *Escherichia coli* |
| N1996 | clade_253, (clade_309 or clade_309c or clade_309e or clade_309g or clade_309h or clade_309i), (clade_479 or clade_479c or clade_479g or clade_479h) | *Blautia producta, Clostridium disporicum,* Erysipelotrichaceae bacterium 3_1_53 |
| N1997 | clade_253, (clade_309 or clade_309c or clade_309e or clade_309g or clade_309h or clade_309i), (clade_479 or clade_479c or clade_479g or clade_479h), (clade_497 or clade_497e or clade_497f), (clade_92 or clade_92e or clade_92i) | *Blautia producta, Clostridium disporicum, Enterococcus faecium,* Erysipelotrichaceae bacterium 3_1_53, *Escherichia coli* |
| N1998 | (clade_378 or clade_378e), (clade_38 or clade_38e or clade_38i), (clade_65 or clade_65e) | *Bacteroides* sp. 1_1_6, *Bacteroides* sp. 3_1_23, *Bacteroides vulgatus* |
| N1999 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_354 or clade_354e), (clade_408 or clade_408b or clade_408d or clade_408f or clade_408g or clade_408h), (clade_444 or clade_444i), (clade_478 or clade_478i), (clade_553 or clade_553i) | *Blautia producta, Clostridium bolteae, Clostridium butyricum, Clostridium disporicum, Clostridium mayombei, Clostridium symbiosum, Collinsella aerofaciens, Coprococcus comes, Eubacterium rectale, Faecalibacterium prausnitzii,* Lachnospiraceae bacterium 5_1_57FAA |
| N2000 | clade_252, clade_253, (clade_262 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_479 or clade_479c or clade_479g or clade_479h) | *Blautia producta, Clostridium butyricum, Clostridium disporicum, Clostridium mayombei, Dorea formicigenerans,* Erysipelotrichaceae bacterium 3_1_53, *Eubacterium tenue, Ruminococcus torques* |
| N2001 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_351 or clade_351e), (clade_354 or clade_354e), (clade_360 or clade_360c or clade_360g or clade_360h or clade_360i), (clade_408 or clade_408b or clade_408d or clade_408f or clade_408g or clade_408h), clade_494, clade_537, (clade_553 or clade_553i) | *Blautia producta, Clostridium bolteae, Clostridium disporicum, Clostridium hylemonae, Clostridium innocuum, Clostridium mayombei, Clostridium orbiscindens, Clostridium symbiosum, Clostridium tertium, Collinsella aerofaciens, Coprococcus comes,* Lachnospiraceae bacterium 5_1_57FAA, *Ruminococcus bromii, Ruminococcus gnavus* |
| N2002 | clade_252, clade_253, (clade_309 or clade_309c or clade_309e or clade_309g or clade_309h or clade_309i), (clade_354 or clade_354e), (clade_479 or clade_479c or clade_479g or clade_479h) | *Blautia producta, Clostridium butyricum, Clostridium disporicum, Clostridium mayombei,* Erysipelotrichaceae bacterium 3_1_53 |
| N2003 | clade_252, clade_253, (clade_260 or clade_260c or clade_260g or clade_260h), (clade_262 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_38 or clade_38e or clade_38i), (clade_408 or clade_408b or clade_408d or clade_408f or clade_408g or clade_408h), (clade_481 or clade_481a or clade_481b or clade_481e or clade_481g or clade_481h or clade_481i), clade_537, (clade_553 or clade_553i) | *Blautia producta, Clostridium bolteae, Clostridium butyricum, Clostridium disporicum, Clostridium hylemonae, Clostridium mayombei, Clostridium sordellii, Clostridium symbiosum, Clostridium tertium, Collinsella aerofaciens, Coprobacillus* sp. D7, *Coprococcus comes, Eubacterium* sp. WAL 14571, Lachnospiraceae bacterium 5_1_57FAA, *Rumtinococcus bromii, Ruminococcus gnavus* |
| N2004 | (clade_351 or clade_351e), (clade_378 or clade_378e), (clade_38 or clade_38e or clade_38i), (clade_497 or clade_497e or clade_497f), (clade_65 or clade_65e), (clade_92 or clade_92e or clade_92i) | *Bacteroides* sp. 1_1_6, *Bacteroides* sp. 3_1_23, *Bacteroides vulgatus, Clostridium innocuum, Enterococcus faecalis, Escherichia coli* |

TABLE 10-continued

| Network Ecology ID | Exemplary Network Clades | Exemplary Network OTUs |
| --- | --- | --- |
| N2005 | (clade_309 or clade_309c or dade_309e or clade_309g or clade_309h or clade_309i) (clade_378 or clade_378e), (clade_38 or clade_38e or clade_38i), (clade_497 or clade_497e or clade_497f), (clade_65 or clade_65e), (clade_92 or clade_92e or clade_92i) | *Bacteroides* sp. 1_1_6, *Bacteroides* sp. 3_1_23, *Bacteroides vulgatus, Blautia producta, Enterococcus faecalis, Escherichia coli* |
| N2006 | clade_170, (clade_262 or clade_262i), (clade_309 or clade_309c or clade_309e or clade_309g or clade_309h or clade_309i), (clade_360 or clade_360c or clade_360g or clade_360h or clade_360i), (clade_444 or clade_444i), (clade_478 or clade_478i), (clade_65 or dade_65e) | *Bacteroides caccae, Bacteroides* sp. 1_1_6, *Coprococcus comes, Dorea formicigenerans, Dorea longicatena, Eubacterium rectale, Faecalibacterium prausnitzii, Ruminococcus obeum, Ruminococcus torques* |
| N2007 | clade_253, (clade_202 or clade_262i), (clade_309 or clade_309c or clade_309e or clade_309g or clade_309h or clade_309i), (clade_354 or clade_354e), (clade_360 or clade_360c or clade_360g or clade_360h or clade_360i), (clade_378 or clade_378e), (clade_408 or clade_408b or clade_408d or clade_408f or clade_408g or clade_408h), (clade_444 or clade_444i), clade_466, (clade_478 or clade_478i), (clade_479 or clade_479c or clade_479g or clade_479h), (clade_481 or clade_481a or clade_481b or clade_481e or clade_481g or clade_481h or clade_481i), (clade_497 or clade_497e or clade_497f), (clade_65 or clade_65e) | *Bacteroides* sp. 1_1_6, *Bacteroides vulgatus, Clostridium disporicum, Clostridium mayombei, Clostridium symbiosum, Coprobacillus* sp. D7, *Coprococcus comes, Dorea formicigenerans, Enterococcus faecalis,* Erysipelotrichaceae bacterium 3_1_53, *Eubacterium rectale, Faecalibacterium prausnitzii, Odoribacter splanchnicus, Ruminococcus obeum* |

TABLE 11

| OTU | Clade | Genus | Family | Order | Spore Former | Percent of Dose Ecologies Occurs | Percent of Engrafted Ecologies Occurs | Percent of Augmented Ecologies Occurs | Keystone OTU | CES |
|---|---|---|---|---|---|---|---|---|---|---|
| Blautia_luti | clade_309 | Blautia | Lachnospiraceae | Clostridiales | yes | 100 | 100 | 0 | 0 | 4.0 |
| Blautia_schinkii | clade_309 | Blautia | Lachnospiraceae | Clostridiales | yes | 100 | 93 | 7 | 0 | 4.0 |
| Blautia_sp_M25 | clade_309 | Blautia | Lachnospiraceae | Clostridiales | yes | 100 | 93 | 7 | 1 | 5.0 |
| Subdoligranulum_variabile | clade_478 | Subdoligranulum | Ruminococcaceae | Clostridiales | yes | 100 | 93 | 0 | 0 | 5.0 |
| Eubacterium_rectale | clade_444 | Eubacterium | Eubacteriaceae | Clostridiales | yes | 100 | 87 | 13 | 1 | 5.0 |
| Lacimospiraceae_bacterium_2_1_58FAA | clade_360 | unassigned | Lachnospiraceae | Clostridiales | yes | 100 | 80 | 7 | 0 | 4.0 |
| Clostridium_leptum | clade_537 | Clostridium | Clostridiaceae | Clostridiales | yes | 100 | 73 | 13 | 1 | 4.0 |
| Faecalibacterium_prausnitzii | clade_478 | Faecalibacterium | Ruminococcaceae | Clostridiales | yes | 100 | 73 | 0 | 1 | 4.0 |
| Ruminococcus_bromii | clade_537 | Ruminococcus | Ruminococcaceae | Clostridiales | yes | 100 | 67 | 7 | 0 | 4.0 |
| Clostridium_citroniae | clade_408 | Clostridium | Clostridiaceae | Clostridiales | yes | 100 | 67 | 7 | 0 | 4.0 |
| Christensenella_minuta | clade_558 | Christensenella | Christensenellaceae | Clostridiales | yes | 100 | 53 | 27 | 0 | 3.0 |
| Ruminococcus_torques | clade_408 | Clostridium | Lachnospiraceae | Clostridiales | yes | 100 | 0 | 27 | 0 | 2.0 |
| Dorea_longicatena | clade_262 | Blautia | Lachnospiraceae | Clostridiales | yes | 93 | 87 | 7 | 1 | 5.0 |
| Dorea_formicigenerans | clade_360 | Dorea | Lachnospiraceae | Clostridiales | yes | 93 | 80 | 20 | 1 | 5.0 |
| Blautia_hansenii | clade_408 | Anaerostipes | Lachnospiraceae | Clostridiales | yes | 93 | 80 | 7 | 1 | 5.0 |
| Clostridium_ramosum | clade_309 | Blautia | Lachnospiraceae | Clostridiales | yes | 93 | 73 | 13 | 0 | 3.0 |
| Ruminococcus_lactaris | clade_481 | unassigned | Erysipelotrichaceae | Erysipelotrichales | yes | 93 | 73 | 13 | 0 | 3.0 |
| Clostridiales_sp_SS3_4 | clade_262 | Ruminococcus | Ruminococcaceae | Clostridiales | yes | 93 | 67 | 33 | 1 | 4.0 |
| Dorea_formicigeneraus | clade_246 | Clostridiales | unclassified | Clostridiales | yes | 86 | 73 | 20 | 0 | 3.0 |
| Coprococcus_comes | clade_360 | Dorea | Lachnospiraceae | Clostridiales | yes | 86 | 53 | 7 | 0 | 4.0 |
| Lachnospiraceae_bacterium_A4 | clade_262 | Coprococcus | Lachnospiraceae | Clostridiales | yes | 86 | 47 | 0 | 1 | 4.0 |
| Eubacterium_hallii | clade_408 | unassigned | Lachnospiraceae | Clostridiales | yes | 86 | 40 | 20 | 0 | 2.4 |
| Eubacterium_brachy | clade_396 | Eubacterium | Eubacteriaceae | Clostridiales | yes | 86 | 40 | 7 | 0 | 3.4 |
| Ruminococcus_callidus | clade_533 | Eubacterium | Eubacteriaceae | Clostridiales | yes | 79 | 13 | 0 | 0 | 2.4 |
| Clostridium_bartlettii | clade_406 | Ruminococcus | Ruminococcaceae | Clostridiales | yes | 79 | 67 | 13 | 0 | 2.3 |
| Clostridium_sporosphaeroides | clade_354 | unassigned | Peptostreptococcaceae | Clostridiales | yes | 79 | 67 | 7 | 0 | 2.3 |
| Clostridium_bifermentans | clade_537 | Clostridium | Clostridiaceae | Clostridiales | yes | 79 | 60 | 20 | 0 | 2.3 |
| Turicibacter_sanguinis | clade_354 | unassigned | Peptostreptococcaceae | Clostridiales | yes | 79 | 53 | 13 | 0 | 2.3 |
| Ruminococcus_albus | clade_555 | Turicibacter | Erysipelotrichaceae | Erysipelotrichales | yes | 79 | 40 | 13 | 0 | 1.7 |
| Eubacterium_ramulus | clade_516 | Ruminococcus | Ruminococcaceae | Clostridiales | yes | 71 | 60 | 27 | 0 | 2.3 |
| Eubacterium_desmolans | clade_482 | Eubacterium | Eubacteriaceae | Clostridiales | yes | 71 | 47 | 33 | 0 | 2.3 |
| Coprococcus_catus | clade_572 | Eubacterium | Eubacteriaceae | Clostridiales | yes | 71 | 40 | 27 | 0 | 1.7 |
| Clostridium_oroticum | clade_393 | Coprococcus | Lachnospiraceae | Clostridiales | yes | 71 | 33 | 7 | 1 | 2.7 |
| Blautia_glucerasea | clade_96 | Clostridium | Clostridiaceae | Clostridiales | yes | 64 | 33 | 33 | 0 | 1.7 |
| Lachnospiraceae_bacterium_3_1_57FAA | clade_309 | Blautia | Lachnospiraceae | Clostridiales | yes | 64 | 33 | 13 | 1 | 2.7 |
| Clostridium_viride | clade_408 | unassigned | Lachnospiraceae | Clostridiales | yes | 64 | 27 | 13 | 0 | 1.7 |
| Ruminococcus_obeum | clade_540 | Clostridium | Clostridiaceae | Clostridiales | yes | 64 | 27 | 7 | 0 | 2.7 |
| Eubacterium_ruminantium | clade_309 | Blautia | Lachnospiraceae | Clostridiales | yes | 57 | 27 | 27 | 0 | 1.7 |
| Eubacterium_thermocellum | clade_543 | Eubacterium | Eubacteriaceae | Clostridiales | yes | 50 | 20 | 20 | 0 | 1.7 |
| Oscillibacter_valericigenes | clade_495 | Clostridium | Clostridiaceae | Clostridiales | yes | 50 | 47 | 60 | 0 | 2.3 |
| Eubacterium_coprostanoligenes | clade_540 | Oscillibacter | Oscillospiraceae | Clostridiales | yes | 50 | 40 | 60 | 1 | 2.7 |
| Clostridium_disporicum | clade_537 | Eubacterium | Eubacteriaceae | Clostridiales | yes | 50 | 27 | 13 | 1 | 2.7 |
| Clostridium_mayombei | clade_253 | Clostridium | Clostridiaceae | Clostridiales | yes | 50 | 20 | 27 | 0 | 1.7 |
| Roseburia_faecalis | clade_354 | Clostridium | Clostridiaceae | Clostridiales | yes | 43 | 20 | 0 | 0 | 1.7 |
| Lachnospiraceae_bacterium_1_4_56FAA | clade_444 | Roseburia | Lachnospiraceae | Clostridiales | yes | 43 | 27 | 60 | 1 | 2.7 |
| Clostridium_spiroforme | clade_262 | unassigned | Lachnospiraceae | Clostridiales | yes | 43 | 13 | 20 | 0 | 1.7 |
| | clade_481 | unassigned | Erysipelotrichaceae | Erysipelotrichales | yes | 36 | 33 | 33 | 0 | 1.7 |

TABLE 11-continued

| OTU | Clade | Genus | Family | Order | Spore Former | Percent of Dose Ecologies Occurs | Percent of Engrafted Ecologies Occurs | Percent of Augmented Ecologies Occurs | Keystone OTU | CES |
|---|---|---|---|---|---|---|---|---|---|---|
| Eubacterium_siraeum | clade_538 | Eubacterium | Eubacteriaceae | Clostridiales | yes | 36 | 27 | 60 | 1 | 2.7 |
| Lachnospira_pectinoschiza | clade_522 | Lachnospira | Lachnospiraceae | Clostridiales | yes | 36 | 27 | 53 | 0 | 1.7 |
| Papillibacter_cinnamivorans | clade_572 | Papillibacter | Ruminococcaceae | Clostridiales | yes | 36 | 27 | 53 | 0 | 1.7 |
| Clostridium_tyrobutyricum | clade_430 | Clostridium | Clostridiaceae | Clostridiales | yes | 36 | 27 | 13 | 0 | 1.7 |
| Roseburia_inulinivorans | clade_444 | Roseburia | Lachnospiraceae | Clostridiales | yes | 36 | 20 | 60 | 1 | 2.7 |
| Ethanoligenens_harbinense | clade_439 | Ethanoligenens | Ruminococcaceae | Clostridiales | yes | 36 | 20 | 27 | 0 | 1.7 |
| Eggerthella_lenta | clade_566 | Eggerthella | Coriobacteriaceae | Coriobacteriales | yes | 36 | 13 | 40 | 0 | 1.1 |
| Clostridium_orbiscindens | clade_494 | unassigned | unassigned | Clostridiales | yes | 29 | 20 | 60 | 0 | 1.1 |
| Eubacterium_ventriosum | clade_519 | Eubacterium | Eubacteriaceae | Clostridiales | yes | 29 | 20 | 40 | 0 | 1.1 |
| Clostridium_paraputrificum | clade_223 | Clostridium | Clostridiaceae | Clostridiales | yes | 29 | 13 | 33 | 0 | 1.1 |
| Clostridium_sp_YIT_12069 | clade_537 | Clostridium | Clostridiaceae | Clostridiales | yes | 29 | 7 | 53 | 0 | 1.1 |
| Eubacterium_barkeri | clade_512 | Eubacterium | Eubacteriaceae | Clostridiales | yes | 29 | 0 | 13 | 0 | 0.7 |
| Eubacterium_biforme | clade_385 | unassigned | Erysipelotrichaceae | Erysipelotrichales | yes | 29 | 0 | 13 | 0 | 0.7 |
| Alkaliphilus_oremlandii | clade_554 | Alkaliphilus | Clostridiaceae | Clostridiales | yes | 29 | 0 | 7 | 0 | 0.7 |
| Lachnospiraceae_bacterium_5_1_57FAA | clade_260 | unassigned | Lachnospiraceae | Clostridiales | yes | 21 | 20 | 60 | 0 | 1.1 |
| Eubacterium_eligens | clade_522 | Eubacterium | Eubacteriaceae | Clostridiales | yes | 21 | 20 | 33 | 0 | 1.1 |
| Bacillus_sp_9_3AIA | clade_527 | Bacillus | Bacillaceae | Bacillales | yes | 21 | 13 | 73 | 0 | 1.1 |
| Eubacterium_sp_WAL_14571 | clade_384 | Eubacterium | Eubacteriaceae | Clostridiales | yes | 21 | 7 | 60 | 0 | 1.1 |
| Anaerosporobacter_mobilis | clade_396 | Anaerosporobacter | Clostridiaceae | Clostridiales | yes | 21 | 7 | 47 | 0 | 1.1 |
| Coprococcus_eutactus | clade_543 | Coprococcus | Lachnospiraceae | Clostridiales | yes | 21 | 7 | 20 | 0 | 1.1 |
| Eubacterium_sp_oral_clone_JH012 | clade_476 | Eubacterium | Eubacteriaceae | Clostridiales | yes | 21 | 7 | 13 | 0 | 1.1 |
| Lachnospira_multipara | clade_522 | Lachnospira | Lachnospiraceae | Clostridiales | yes | 21 | 7 | 13 | 0 | 1.1 |
| Clostridium_carnis | clade_253 | Clostridium | Clostridiaceae | Clostridiales | yes | 21 | 7 | 0 | 0 | 1.1 |
| Clostridium_colinum | clade_576 | Clostridium | Clostridiaceae | Clostridiales | yes | 21 | 0 | 0 | 0 | 0.7 |
| Clostridium_hylemonae | clade_260 | Clostridium | Clostridiaceae | Clostridiales | yes | 21 | 0 | 40 | 0 | 0.7 |
| Gloeobacter_violaceus | clade_596 | Gloeobacter | unassigned | Gloeobacterales | yes | 21 | 0 | 7 | 0 | 0.7 |
| Clostridium_algidicarnis | clade_430 | Clostridium | Clostridiaceae | Clostridiales | yes | 14 | 20 | 67 | 0 | 1.1 |
| Holdemania_filiformis | clade_485 | Holdemania | Erysipelotrichaceae | Erysipelotrichales | yes | 14 | 13 | 73 | 1 | 2.1 |
| Clostridium_aldenense | clade_408 | Clostridium | Clostridiaceae | Clostridiales | yes | 14 | 13 | 67 | 0 | 1.1 |
| Sporobacter_termitidis | clade_572 | Sporobacter | Ruminococcaceae | Clostridiales | yes | 14 | 13 | 67 | 1 | 2.1 |
| Ruminococcus_sp_ID8 | clade_360 | Ruminococcus | Ruminococcaceae | Clostridiales | yes | 14 | 13 | 47 | 0 | 1.1 |
| Lachnospiraceae_bacterium_4_1_37FAA | clade_360 | unassigned | Lachnospiraceae | Clostridiales | yes | 14 | 0 | 60 | 0 | 0.7 |
| Ruminococcus_sp_18P13 | clade_406 | Ruminococcus | Ruminococcaceae | Clostridiales | yes | 14 | 0 | 7 | 0 | 0.7 |
| Blautia_hydrogenotrophica | clade_368 | Blautia | Lachnospiraceae | Clostridiales | yes | 14 | 0 | 0 | 0 | 0.7 |
| Anaerotruncus_colihominis | clade_516 | Anaerotruncus | Ruminococcaceae | Clostridiales | yes | 7 | 7 | 93 | 1 | 2.1 |
| Clostridium_symbiosum | clade_408 | Clostridium | Clostridiaceae | Clostridiales | yes | 7 | 7 | 87 | 0 | 1.1 |
| Clostridium_lactatifermentans | clade_576 | Clostridium | Clostridiaceae | Clostridiales | yes | 7 | 7 | 80 | 1 | 2.1 |
| Lactobacillus_rogosae | clade_522 | Lactobacillus | Lactobacillaceae | Lactobacillases | yes | 7 | 7 | 80 | 0 | 1.1 |
| Clostridium_sp_HGF2 | clade_351 | Clostridium | Clostridiaceae | Clostridiales | yes | 7 | 7 | 47 | 0 | 1.1 |
| Clostridium_sp_SY8519 | clade_482 | Clostridium | Clostridiaceae | Clostridiales | yes | 7 | 7 | 47 | 0 | 1.1 |
| Desulfotomaculum_nigrificans | clade_560 | Desulfotomaculum | Peptococcaceae | Clostridiales | yes | 7 | 7 | 60 | 0 | 1.1 |
| Eubacterium_cylindroides | clade_385 | unassigned | Erysipelotrichaceae | Erysipelotrichales | yes | 7 | 7 | 7 | 0 | 1.1 |
| Ruminococcus_sp_K_1 | clade_309 | Ruminococcus | Ruminococcaceae | Clostridiales | yes | 7 | 7 | 0 | 0 | 1.1 |
| Lachnospiraceae_bacterium_oral_taxon_F15 | clade_393 | unassigned | Lachnospiraceae | Clostridiales | yes | 7 | 0 | 53 | 0 | 0.7 |
| Clostridium_nexile | clade_262 | Clostridium | Clostridiaceae | Clostridiales | yes | 7 | 0 | 40 | 1 | 1.7 |
| Acetanaerobacterium_elongatum | clade_439 | Acetanaerobacterium | Ruminococcaceae | Clostridiales | yes | 7 | 0 | 7 | 0 | 0.7 |
| Butyricicoccus_pullicaecorum | clade_572 | Butyricicoccus | Clostridiaceae | Clostridiales | yes | 7 | 0 | 0 | 1 | 1.7 |
| Clostridium_butyricum | clade_252 | Clostridium | Clostridiaceae | Clostridiales | yes | 7 | 0 | 0 | 0 | 0.7 |

TABLE 11-continued

| OTU | Clade | Genus | Family | Order | Spore Former | Percent of Dose Ecologies Occurs | Percent of Engrafted Ecologies Occurs | Percent of Augmented Ecologies Occurs | Keystone OTU | CES |
|---|---|---|---|---|---|---|---|---|---|---|
| Solobacterium_moorei | clade_388 | Solobacterium | Erysipelotrichaceae | Erysipelotrichales | yes | 7 | 0 | 0 | 0 | 0.7 |
| Bacteroides_uniformis | clade_110 | Bacteroides | Bacteroidaceae | Bacteroidales | no | | 87 | 13 | 0 | 4.0 |
| Alloscardovia_sp_OB7196 | clade_475 | Alloscardovia | Bifidobacteriaceae | Bifidobacteriales | no | | 53 | 33 | 0 | 2.3 |
| Clostridiales_bacterium_oral_clone_P4PA | clade_558 | unassigned | unassigned | Clostridiales | no | | 47 | 27 | 0 | 2.3 |
| Enterococcus_faecium | clade_497 | Enterococcus | Enterococcaceae | Lactobacillales | no | | 47 | 7 | 0 | 3.0 |
| Clostridiales_bacterium_oral_taxon_F32 | clade_584 | unassigned | unassigned | Clostridiales | no | | 40 | 0 | 0 | 1.7 |
| Bifidobacterium_breve | clade_172 | Bifidobacterium | Bifidobacteriaceae | Bifidobacteriales | no | | 33 | 7 | 0 | 2.4 |
| Bifidobacterium_longum | clade_172 | Bifidobacterium | Bifidobacteriaceae | Bifidobacteriales | no | | 33 | 0 | 0 | 2.7 |
| Bacteroides_oleiciplenus | clade_85 | Bacteroides | Bacteroidaceae | Bacteroidales | no | | 27 | 47 | 0 | 1.7 |
| Dialister_invisus | clade_506 | Dialister | Veillonellaceae | Selenomonadales | no | | 27 | 47 | 0 | 1.7 |
| Anaerobaculum_hydrogeniformans | clade_591 | Anaerobaculum | Synergistaceae | Synergistales | no | | 20 | 27 | 0 | 1.7 |
| Streptococcus_sp_oral_taxon_G63 | clade_98 | Streptococcus | Streptococcaceae | Lactobacillales | no | | 20 | 13 | 0 | 1.7 |
| Streptococcus_thermophilus | clade_98 | Streptococcus | Streptococcaceae | Lactobacillales | no | | 20 | 13 | 0 | 2.4 |
| Dialister_micraerophilus | clade_506 | Dialister | Veillonellaceae | Selenomonadales | no | | 20 | 7 | 0 | 1.7 |
| Bifidobacterium_animalis | clade_172 | Bifidobacterium | Bifidobacteriaceae | Bifidobacteriales | no | | 20 | 7 | 0 | 1.7 |
| Lactobacillus_iners | clade_398 | Lactobacillus | Lactobacillaceae | Lactobacillales | no | | 20 | 0 | 0 | 1.7 |
| Butyrivibrio_fibrisolvens | clade_444 | Butyrivibrio | Lachnospiraceae | Clostridiales | no | | 13 | 67 | 1 | 1.1 |
| Streptococcus_sp_ACS2 | clade_98 | Streptococcus | Streptococcaceae | Lactobacillales | no | | 13 | 33 | 0 | 1.7 |
| Lactococcus_lactis | clade_401 | Lactococcus | Streptococcaceae | Lactobacillales | no | | 13 | 13 | 0 | 1.7 |
| Lactobacillus_delbrueckii | clade_398 | Lactobacillus | Lactobacillaceae | Lactobacillales | no | | 13 | 13 | 0 | 1.7 |
| Cytophaga_xylanolytica | clade_72 | Cytophaga | Cytophagaceae | Cytophagales | no | | 7 | 53 | 0 | 1.1 |
| Streptococcus_gallolyticus | clade_98 | Streptococcus | Streptococcaceae | Lactobacillales | no | | 7 | 33 | 0 | 1.1 |
| Marvinbryantia_formatexigens | clade_309 | unassigned | Lachnospiraceae | Clostridiales | no | | 7 | 33 | 0 | 1.7 |
| Akkermansia_muciniphila | clade_583 | Akkermansia | Verrucomicrobiaceae | Verrucomicrobiales | no | | 7 | 20 | 1 | 2.7 |
| Bacteroides_dorei | clade_378 | Bacteroides | Bacteroidaceae | Bacteroidales | no | | 7 | 20 | 1 | 2.7 |
| Megasphaera_genomosp_type_1_28L | clade_506 | Megasphaera | Veillonellaceae | Selenomonadales | no | | 7 | 20 | 0 | 1.1 |
| Lactobacillus_hominis | clade_398 | Lactobacillus | Lactobacillaceae | Lactobacillales | no | | 7 | 13 | 0 | 1.7 |
| Actinomyces_oricola | clade_54 | Actinomyces | Actinomycetaceae | Actinomycetales | no | | 7 | 13 | 0 | 1.1 |
| Streptobacillus_moniliformis | clade_532 | Streptobacillus | Leptotrichiaceae | Fusobacteriales | no | | 7 | 13 | 0 | 1.1 |
| Streptococcus_sp_oral_clone_ASCB06 | clade_98 | Streptococcus | Streptococcaceae | Lactobacillales | no | | 7 | 7 | 0 | 1.1 |
| Bacteroides_sp_D20 | clade_110 | Bacteroides | Bacteroidaceae | Bacteroidales | no | | 7 | 7 | 1 | 2.1 |
| Collinsella_intestinalis | clade_553 | Collinsella | Coriobacteriaceae | Coriobacteriales | no | | 7 | 0 | 0 | 1.7 |
| Methanosphaera_stadtmanae | clade_595 | Methanosphaera | Methanobacteriaceae | Methanobacteriales | no | | 0 | 0 | 0 | 1.7 |
| Streptococcus_vestibularis | clade_98 | Streptococcus | Streptococcaceae | Lactobacillales | no | | 0 | 0 | 0 | 1.1 |
| Clostridiaceae_bacterium_END_2 | clade_368 | unassigned | Clostridiaceae | Clostridiales | no | | 0 | 53 | 0 | 0.7 |
| Parabacteroides_distasonis | clade_335 | Parabacteroides | Porphyromonadaceae | Bacteroidales | no | | 0 | 27 | 0 | 1.3 |
| Veillonella_dispar | clade_358 | Veillonella | Veillonellaceae | Selenomonadales | no | | 0 | 27 | 0 | 0.7 |
| Bacteroides_caccae | clade_170 | Bacteroides | Bacteroidaceae | Bacteroidales | no | | 0 | 20 | 1 | 1.7 |
| Veillonella_sp_3_1_44 | clade_358 | Veillonella | Veillonellaceae | Selenomonadales | no | | 0 | 20 | 0 | 0.7 |
| Megasphaera_micronuciformis | clade_493 | Megasphaera | Veillonellaceae | Selenomonadales | no | | 0 | 20 | 0 | 0.7 |
| Oxalobacter_formigenes | clade_357 | Oxalobacter | Oxalobacteraceae | Burkholderiales | no | | 0 | 20 | 0 | 0.7 |
| Streptococcus_parasanguinis | clade_98 | Streptococcus | Streptococcaceae | Lactobacillales | no | | 0 | 13 | 1 | 2.3 |
| Bacteroides_fragilis | clade_65 | Bacteroides | Bacteroidaceae | Bacteroidales | no | | 0 | 13 | 0 | 0.7 |
| Bacteroides_sp_4_1_36 | clade_110 | Bacteroides | Bacteroidaceae | Bacteroidales | no | | 0 | 13 | 0 | 0.7 |
| Lactobacillus_sp_BT6 | clade_373 | Lactobacillus | Lactobacillaceae | Lactobacillales | no | | 0 | 13 | 0 | 0.7 |
| Bacteroides_sp_1_1_14 | clade_65 | Bacteroides | Bacteroidaceae | Bacteroidales | no | | 0 | 13 | 0 | 0.7 |
| Escherichia_hermannii | clade_92 | Escherichia | Enterobacteriaceae | Enterobacteriales | no | | 0 | 13 | 0 | 0.7 |
| Escherichia_sp_B4 | clade_92 | Escherichia | Enterobacteriaceae | Enterobacteriales | no | | 0 | 13 | 0 | 0.7 |

TABLE 11-continued

| OTU | Clade | Genus | Family | Order | Spore Former | Percent of Dose Ecologies Occurs | Percent of Engrafted Ecologies Occurs | Percent of Augmented Ecologies Occurs | Keystone OTU | CES |
|---|---|---|---|---|---|---|---|---|---|---|
| Gemella_moribillorum | clade_450 | Gemella | unassigned | Bacillales | no | | 0 | 13 | 0 | 0.7 |
| Klebsiella_variicola | clade_92 | Klebsiella | Enterobacteriaceae | Enterobacteriales | no | | 0 | 13 | 0 | 0.7 |
| Phascolarctobacterium_succinatutens | clade_556 | Phascolarctobacterium | Acidaminococcaceae | Selenomonadales | no | | 0 | 13 | 0 | 0.7 |
| Streptococcus_sp_CM7 | clade_60 | Streptococcus | Streptococcaceae | Lactobacillales | no | | 0 | 13 | 0 | 0.7 |
| Bilophila_wadsworthia | clade_521 | Bilophila | Desulfovibrionaceae | Desulfovibrionales | no | | 0 | 7 | 1 | 2.3 |
| Streptococcus_sp_oral_clone_GM006 | clade_98 | Streptococcus | Streptococcaceae | Lactobacillales | no | | 0 | 7 | 0 | 1.3 |
| Adlercreutzia_equolifaciens | clade_566 | Adlercreutzia | Coriobacteriaceae | Coriobacteriales | no | | 0 | 7 | 0 | 0.7 |
| Lactobacillus_murinus | clade_449 | Lactobacillus | Lactobacillaceae | Lactobacillales | no | | 0 | 7 | 0 | 0.7 |
| Helicobacter_pullorum | clade_489 | Helicobacter | Helicobacteraceae | Campylobacterales | no | | 0 | 7 | 0 | 0.7 |
| Alistipes_finegoldii | clade_500 | Alistipes | Rikenellaceae | Bacteroidales | no | | 0 | 7 | 0 | 0.7 |
| Averyella_dalhousiensis | clade_92 | Averyella | Enterobacteriaceae | Enterobacteriales | no | | 0 | 7 | 0 | 0.7 |
| Desulfovibrio_desulfuricans | clade_445 | Desulfovibrio | Desulfovibrionaceae | Desulfovibrionales | no | | 0 | 7 | 0 | 0.7 |
| Plesiomonas_shigelloides | clade_92 | Plesiomonas | Enterobacteriaceae | Enterobacteriales | no | | 0 | 7 | 0 | 0.7 |
| Actinomyces_israelii | clade_212 | Actinomyces | Actinomycetaceae | Actinomycetales | no | | 0 | 7 | 0 | 0.7 |
| Bacteroidales_genomosp_P1 | clade_529 | unassigned | unassigned | Bacteroidales | no | | 0 | 7 | 0 | 0.7 |
| Bifidobacterium_bifidum | clade_293 | Bifidobacterium | Bifidobacteriaceae | Bifidobacteriales | no | | 0 | 7 | 0 | 0.7 |
| Cedecea_davisae | clade_92 | Cedecea | Enterobacteriaceae | Enterobacteriales | no | | 0 | 7 | 0 | 0.7 |
| Gardnerella_vaginalis | clade_344 | Gardnerella | Bifidobacteriaceae | Bifidobacteriales | no | | 0 | 7 | 0 | 0.7 |
| Lactobacillus_fermentum | clade_313 | Lactobacillus | Lactobacillaceae | Lactobacillales | no | | 0 | 7 | 0 | 0.7 |
| Lactobacillus_reuteri | clade_313 | Lactobacillus | Lactobacillaceae | Lactobacillales | no | | 0 | 8 | 0 | 0.7 |
| Lactococcus_raffinolactis | clade_524 | Lactococcus | Streptococcaceae | Lactobacillales | no | | 0 | 7 | 0 | 0.7 |
| Pediococcus_pentosaceus | clade_372 | Pediococcus | Lactobacillaceae | Lactobacillales | no | | 0 | 7 | 0 | 0.7 |
| Prevotella_denticola | clade_83 | Prevotella | Prevotellaceae | Bacteroidales | no | | 0 | 7 | 0 | 0.7 |
| Rothia_mucilaginosa | clade_271 | Rothia | Micrococcaceae | Actinomycetales | no | | 0 | 7 | 1 | 1.7 |
| Sutterella_stercoricanis | clade_432 | Sutterella | Sutterellaceae | Burkholderiales | no | | 0 | 7 | 0 | 0.7 |
| Eggerthella_sp_1_3_56FAA | clade_566 | Eggerthella | Coriobacteriaceae | Coriobacteriales | no | | 0 | 0 | 0 | 1.3 |
| Coriobacteriaceae_bacterium_JC110 | clade_566 | unassigned | Coriobacteriaceae | Coriobacteriales | no | | 0 | 0 | 0 | 1.3 |
| Megamonas_funiformis | clade_542 | Megamonas | Veillonellaceae | Selenomonadales | no | | 0 | 0 | 0 | 1.3 |
| Gordonibacter_pamelaeae | clade_566 | Gordonibacter | Coriobacteriaceae | Coriobacteriales | no | | 0 | 0 | 0 | 1.3 |
| Bifidobacterium_sp_HM2 | clade_172 | Bifidobacterium | Bifidobacteriaceae | Bifidobacteriales | no | | 0 | 0 | 0 | 0.7 |
| Bacteroides_stercoris | clade_85 | Bacteroides | Bacteroidaceae | Bacteroidales | no | | 0 | 0 | 1 | 1.7 |
| Bifidobacterium_angulatum | clade_172 | Bifidobacterium | Bifidobacteriaceae | Bifidobacteriales | no | | 0 | 0 | 0 | 0.7 |
| Parasutterella_excrementihominis | clade_432 | Parasutterella | Sutterellaceae | Burkholderiales | no | | 0 | 0 | 0 | 0.7 |
| Phascolarctobacterium_faecium | clade_556 | Phascolarctobacterium | Acidaminococcaceae | Selenomonadales | no | | 0 | 0 | 0 | 0.7 |
| Cryptobacterium_curtum | clade_566 | Cryptobacterium | Coriobacteriaceae | Coriobacteriales | no | | 0 | 0 | 0 | 0.7 |
| Prevotella_sp_BI_42 | clade_168 | Prevotella | Prevotellaceae | Bacteroidales | no | | 0 | 0 | 0 | 0.7 |
| Slackia_isoflavoniconvertens | clade_566 | Slackia | Coriobacteriaceae | Coriobacteriales | no | | 0 | 0 | 0 | 0.7 |
| Acidaminococcus_sp_D21 | clade_556 | Acidaminococcus | Acidaminococcaceae | Selenomonadales | no | | 0 | 0 | 0 | 0.7 |
| Atopobium_vaginae | clade_539 | Atopobium | Coriobacteriaceae | Coriobacteriales | no | | 0 | 0 | 0 | 0.7 |
| Catabacter_hongkongensis | clade_558 | Catabacter | Catabacteriaceae | Clostridiales | no | | 0 | 0 | 0 | 0.7 |
| Lactobacillus_ruminis | clade_449 | Lactobacillus | Lactobacillaceae | Lactobacillales | no | | 0 | 0 | 0 | 0.7 |
| Lactobacillus_senioris | clade_398 | Lactobacillus | Lactobacillaceae | Lactobacillales | no | | 0 | 0 | 0 | 0.7 |
| Morganella_morganii | clade_89 | Morganella | Enterobacteriaceae | Enterobacteriales | no | | 0 | 0 | 0 | 0.7 |
| Parabacteroides_merdae | clade_286 | Parabacteroides | Porphyromonadaceae | Bacteroidales | no | | 0 | 0 | 1 | 1.7 |
| Peptoniphilus_harei | clade_389 | Peptoniphilus | Clostridiales Family XI | Clostridiales | no | | 0 | 0 | 0 | 0.7 |
| Streptococcus_downei | clade_441 | Streptococcus | Streptococcaceae | Lactobacillales | no | | 0 | 0 | 0 | 0.7 |

TABLE 12

| OTC1 of Composition | OTC2 of Composition | OTC3 of Composition | Clade of OTU1 | Clade of OTU2 | Clade of OTU3 (if applicable) | C. diff Inhibition Score | Percent of Dose Ecologies Occurs | Percent of Post-treatment Ecologies |
|---|---|---|---|---|---|---|---|---|
| Dorea longicatena | Eubacterium rectale | | clade_360 | clade_444 | | ++++ | 92.9 | 100.0 |
| Ruminococcus torques | Ruminococcus torques | | clade_262 | clade_262 | | ++++ | 92.9 | 93.3 |
| Coprococcus comes | Eubacterium rectale | | clade_262 | clade_444 | | ++++ | 85.7 | 46.7 |
| Coprococcus comes | Ruminococcus bromii | | clade_262 | clade_537 | | ++++ | 85.7 | 26.7 |
| Ruminococcus torques | Coprococcus comes | | clade_262 | clade_262 | | ++++ | 78.6 | 40.0 |
| Ruminococcus obeum | Ruminococcus obeum | | clade_309 | clade_309 | | ++++ | 64.3 | 33.3 |
| Ruminococcus obeum | Coprococcus comes | | clade_309 | clade_262 | | ++++ | 64.3 | 20.0 |
| Ruminococcus torques | Ruminococcus torques | Eubacterium rectale | clade_309 | clade_262 | clade_444 | ++++ | 57.1 | 33.3 |
| Clostridium disporicum | Eubacterium rectale | | clade_253 | clade_444 | | ++++ | 50.0 | 46.7 |
| Clostridium mayombei | Eubacterium rectale | | clade_354 | clade_444 | | ++++ | 50.0 | 20.0 |
| Clostridium mayombei | Faecalibacterium prausnitzii | Eubacterium rectale | clade_354 | clade_478 | clade_444 | ++++ | 50.0 | 20.0 |
| Clostridium mayombei | Faecalibacterium prausnitzii | Faecalibacterium prausnitzii | clade_354 | clade_478 | clade_478 | ++++ | 50.0 | 20.0 |
| Eubacterium rectale | Clostridium mayombei | Blautia sp. M25 | clade_444 | clade_354 | clade_309 | ++++ | 50.0 | 20.0 |
| Eubacterium rectale | Clostridium mayombei | Clostridium mayombei | clade_444 | clade_354 | clade_354 | ++++ | 50.0 | 20.0 |
| Eubacterium rectale | Clostridium mayombei | Ruminococcus bromii | clade_444 | clade_354 | clade_537 | ++++ | 50.0 | 20.0 |
| Faecalibacterium prausnitzii | Clostridium mayombei | Blautia sp. M25 | clade_478 | clade_354 | clade_309 | ++++ | 50.0 | 20.0 |
| Faecalibacterium prausnitzii | Clostridium mayombei | Clostridium mayombei | clade_478 | clade_354 | clade_354 | ++++ | 50.0 | 20.0 |
| Faecalibacterium prausnitzii | Clostridium mayombei | Ruminococcus bromii | clade_478 | clade_354 | clade_537 | ++++ | 50.0 | 20.0 |
| Clostridium mayombei | Clostridium mayombei | | clade_354 | clade_354 | | ++++ | 50.0 | 20.0 |
| Clostridium mayombei | Faecalibacterium prausnitzii | | clade_354 | clade_478 | | ++++ | 50.0 | 20.0 |
| Clostridium mayombei | Ruminococcus bromii | | clade_354 | clade_537 | | ++++ | 50.0 | 20.0 |
| Eubacterium rectale | Eubacterium rectale | | clade_444 | clade_444 | | ++++ | 42.9 | 13.3 |
| Eubacterium rectale | Clostridium disporicum | Clostridium mayombei | clade_444 | clade_253 | clade_354 | ++++ | 42.9 | 13.3 |
| Faecalibacterium prausnitzii | Clostridium disporicum | Clostridium mayombei | clade_478 | clade_253 | clade_354 | ++++ | 42.9 | 13.3 |
| Clostridium mayombei | Clostridium mayombei | | clade_354 | clade_354 | | ++++ | 35.7 | 13.3 |
| Clostridium disporicum | Coprococcus comes | | clade_253 | clade_262 | | ++++ | 28.6 | 80.0 |
| Eubacterium rectale | Clostridium orbiscindens | Blautia sp. M25 | clade_444 | clade_494 | clade_309 | ++++ | 28.6 | 73.3 |
| Faecalibacterium prausnitzii | Clostridium orbiscindens | Blautia sp. M25 | clade_478 | clade_494 | clade_309 | ++++ | 28.6 | 46.7 |
| Clostridium disporicum | Clostridium orbiscindens | | clade_253 | clade_494 | | ++++ | 28.6 | 40.0 |
| Eubacterium rectale | Eubacterium rectale | Eubacterium rectale | clade_260 | clade_444 | clade_444 | ++++ | 21.4 | 40.0 |
| Eubacterium hylemonae | Clostridium hylemonae | Blautia sp. M25 | clade_444 | clade_260 | clade_309 | ++++ | 21.4 | 40.0 |
| Coprococcus comes | Clostridium orbiscindens | Blautia sp. M25 | clade_262 | clade_494 | clade_309 | ++++ | 21.4 | 33.3 |
| Coprococcus comes | Clostridium orbiscindens | | clade_262 | clade_494 | | ++++ | 21.4 | 33.3 |
| Eubacterium rectale | Clostridium mayombei | Clostridium orbiscindens | clade_444 | clade_354 | clade_494 | ++++ | 21.4 | 20.0 |
| Faecalibacterium prausnitzii | Clostridium mayombei | Clostridium orbiscindens | clade_478 | clade_354 | clade_494 | ++++ | 21.4 | 20.0 |
| Clostridium mayombei | Clostridium orbiscindens | | clade_354 | clade_494 | | ++++ | 21.4 | 20.0 |
| Clostridium disporicum | Lachnospiraceae bacterium 5_1_57FAA | | clade_253 | clade_260 | | ++++ | 14.3 | 40.0 |
| Clostridium hylemonae | Lachnospiraceae bacterium 5_1_57FAA | Lachnospiraceae bacterium 5_1_57FAA | clade_260 | clade_260 | clade_260 | +++ | 14.3 | 26.7 |
| Eubacterium hylemonae | Lachnospiraceae bacterium 5_1_57FAA | | clade_260 | clade_260 | | +++ | 14.3 | 26.7 |
| Clostridium hylemonae | Lachnospiraceae bacterium 5_1_57FAA | Eubacterium rectale | clade_260 | clade_260 | clade_444 | +++ | 14.3 | 26.7 |
| Lachnospiraceae bacterium 5_1_57FAA | Clostridium hylemonae | Blautia sp. M25 | clade_260 | clade_260 | clade_309 | +++ | 14.3 | 26.7 |
| Bacteroides caccae | Bacteroides caccae | | clade_170 | clade_170 | | +++ | 14.3 | 20.0 |

TABLE 12-continued

| OTC1 of Composition | OTC2 of Composition | OTC3 of Composition | Clade of OTU1 | Clade of OTU2 | Clade of OTU3 (if applicable) | C. diff Inhibition Score | Percent of Dose Ecologies Occurs | Percent of Post-treatment Ecologies |
|---|---|---|---|---|---|---|---|---|
| Clostridium hylemonae | Faecalibacterium prausnitzii | Lachnospiraceae bacterium 5_1_57FAA | clade_260 | clade_478 | clade_260 | ++++ | 14.3 | 20.0 |
| Bacteroides caccae | Ruminococcus torques | | clade_170 | clade_262 | | ++++ | 14.3 | 20.0 |
| Clostridium mayombei | Faecalibacterium prausnitzii | Lachnospiraceae bacterium 5_1_57FAA | clade_354 | clade_478 | clade_260 | ++++ | 14.3 | 13.3 |
| Clostridium mayombei | Lachnospiraceae bacterium 5_1_57FAA | Eubacterium rectale | clade_354 | clade_260 | clade_444 | ++++ | 14.3 | 13.3 |
| Clostridium mayombei | Lachnospiraceae bacterium 5_1_57FAA | Blautia sp. M25 | clade_354 | clade_260 | clade_260 | ++++ | 14.3 | 13.3 |
| Lachnospiraceae bacterium 5_1_57FAA | Clostridium mayombei | Clostridium mayombei | clade_260 | clade_354 | clade_309 | ++++ | 14.3 | 13.3 |
| Lachnospiraceae bacterium 5_1_57FAA | Clostridium mayombei | Ruminococcus bromii | clade_260 | clade_354 | clade_354 | ++++ | 14.3 | 13.3 |
| Lachnospiraceae bacterium 5_1_57FAA | Clostridium mayombei | | clade_260 | clade_354 | clade_537 | ++++ | 14.3 | 13.3 |
| Clostridium mayombei | Lachnospiraceae bacterium 5_1_57FAA | | clade_354 | clade_260 | | ++++ | 14.3 | 13.3 |
| Coprococcus comes | Clostridium hylemonae | Blautia sp. M25 | clade_262 | clade_260 | clade_309 | ++++ | 14.3 | 13.3 |
| Lachnospiraceae bacterium 5_1_57FAA | Clostridium disporicum | Clostridium mayombei | clade_260 | clade_253 | clade_354 | ++++ | 14.3 | 6.7 |
| Dorea longicatena | Clostridium symbiosum | | clade_360 | clade_408 | clade_309 | ++++ | 7.1 | 93.3 |
| Clostridium symbiosum | Clostridium orbiscindens | Clostridium orbiscindens | clade_408 | clade_494 | clade_494 | ++++ | 7.1 | 80.0 |
| Clostridium symbiosum | Clostridium orbiscindens | Blautia sp. M25 | clade_408 | clade_494 | clade_309 | ++++ | 7.1 | 80.0 |
| Clostridium orbiscindens | Clostridium symbiosum | Lachnospiraceae bacterium 5_1_57FAA | clade_494 | clade_408 | clade_260 | ++++ | 7.1 | 66.7 |
| Lachnospiraceae bacterium 5_1_57FAA | Clostridium orbiscindens | Blautia sp. M25 | clade_260 | clade_494 | clade_309 | ++++ | 7.1 | 66.7 |
| Clostridium symbiosum | Ruminococcus bromii | Ruminococcus bromii | clade_408 | clade_537 | clade_537 | ++++ | 7.1 | 66.7 |
| Clostridium disporicum | Clostridium symbiosum | Lachnospiraceae bacterium 5_1_57FAA | clade_253 | clade_408 | clade_260 | ++++ | 7.1 | 40.0 |
| Clostridium hylemonae | Clostridium symbiosum | Eubacterium rectale | clade_260 | clade_408 | clade_444 | ++++ | 7.1 | 40.0 |
| Coprococcus comes | Lachnospiraceae bacterium 5_1_57FAA | | clade_262 | clade_260 | | ++++ | 7.1 | 33.3 |
| Clostridium symbiosum | Clostridium hylemonae | Ruminococcus bromii | clade_408 | clade_260 | clade_537 | ++++ | 7.1 | 33.3 |
| Clostridium hylemonae | Clostridium symbiosum | Lachnospiraceae bacterium 5_1_57FAA | clade_260 | clade_408 | clade_260 | ++++ | 7.1 | 26.7 |
| Clostridium mayombei | Clostridium symbiosum | Clostridium symbiosum | clade_354 | clade_408 | clade_408 | ++++ | 7.1 | 20.0 |
| Clostridium mayombei | Clostridium symbiosum | Eubacterium rectale | clade_354 | clade_408 | clade_444 | ++++ | 7.1 | 20.0 |
| Clostridium mayombei | Clostridium symbiosum | Faecalibacterium prausnitzii | clade_354 | clade_408 | clade_478 | ++++ | 7.1 | 20.0 |
| Clostridium symbiosum | Clostridium mayombei | Blautia sp. M25 | clade_408 | clade_354 | clade_309 | ++++ | 7.1 | 20.0 |
| Clostridium symbiosum | Clostridium mayombei | Clostridium mayombei | clade_408 | clade_354 | clade_354 | ++++ | 7.1 | 20.0 |
| Clostridium mayombei | Clostridium symbiosum | Clostridium orbiscindens | clade_354 | clade_408 | clade_494 | ++++ | 7.1 | 20.0 |
| Clostridium symbiosum | Clostridium mayombei | Ruminococcus bromii | clade_408 | clade_354 | clade_537 | ++++ | 7.1 | 20.0 |
| Clostridium mayombei | Clostridium symbiosum | Lachnospiraceae bacterium 5_1_57FAA | clade_354 | clade_408 | clade_260 | ++++ | 7.1 | 13.3 |
| Clostridium symbiosum | Clostridium disporicum | Clostridium mayombei | clade_408 | clade_253 | clade_354 | ++++ | 7.1 | 13.3 |
| Clostridium symbiosum | Clostridium symbiosum | Clostridium hylemonae | clade_408 | clade_354 | clade_260 | ++++ | 7.1 | 13.3 |
| Eubacterium rectale | Clostridium mayombei | Clostridium hylemonae | clade_444 | clade_354 | clade_260 | ++++ | 7.1 | 13.3 |

TABLE 12-continued

| OTC1 of Composition | OTC2 of Composition | OTC3 of Composition | Clade of OTU1 | Clade of OTU2 | Clade of OTU3 (if applicable) | C. diff Inhibition Score | Percent of Dose Ecologies Occurs | Percent of Post-treatment Ecologies |
|---|---|---|---|---|---|---|---|---|
| Faecalibacterium prausnitzii | Clostridium mayombei | Clostridium hylemonae | clade_478 | clade_354 | clade_260 | ++++ | 7.1 | 13.3 |
| Lachnospiraceae bacterium 5_1_57FAA | Clostridium mayombei | Clostridium orbiscindens | clade_260 | clade_354 | clade_494 | ++++ | 7.1 | 13.3 |
| Clostridium mayombei | Clostridium hylemonae | | clade_354 | clade_260 | | ++++ | 7.1 | 13.3 |
| Clostridium hylemonae | Coprococcus comes | Lachnospiraceae bacterium 5_1_57FAA | clade_260 | clade_262 | | ++++ | 7.1 | 6.7 |
| Lachnospiraceae bacterium 5_1_57FAA | Clostridium mayombei | Clostridium hylemonae | clade_260 | clade_354 | clade_260 | ++++ | 7.1 | 6.7 |

TABLE 13

| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
|---|---|---|---|---|---|---|---|---|---|---|
| 10 | Y | Y | Y | Y | Y | Y | Y | Y | Y | Y |
| 9 | Y | Y | Y | Y | Y | Y | Y | Y | Y | |
| 9 | Y | Y | Y | Y | Y | Y | Y | Y | | Y |
| 9 | Y | Y | Y | Y | Y | Y | Y | | Y | Y |
| 9 | Y | Y | Y | Y | Y | Y | | Y | Y | Y |
| 9 | Y | Y | Y | Y | Y | | Y | Y | Y | Y |
| 9 | Y | Y | Y | Y | | Y | Y | Y | Y | Y |
| 9 | Y | Y | Y | | Y | Y | Y | Y | Y | Y |
| 9 | Y | Y | | Y | Y | Y | Y | Y | Y | Y |
| 9 | Y | | Y | Y | Y | Y | Y | Y | Y | Y |
| 9 | | Y | Y | Y | Y | Y | Y | Y | Y | Y |
| 8 | Y | Y | Y | Y | Y | Y | Y | Y | | |
| 8 | Y | Y | Y | Y | Y | Y | Y | Y | Y | |
| 8 | Y | Y | Y | Y | Y | Y | Y | | | Y |
| 8 | Y | Y | Y | Y | Y | Y | | Y | Y | |
| 8 | Y | Y | Y | Y | Y | Y | | Y | | Y |
| 8 | Y | Y | Y | Y | Y | Y | | | Y | Y |
| 8 | Y | Y | Y | Y | Y | | Y | Y | Y | |
| 8 | Y | Y | Y | Y | Y | | Y | Y | | Y |
| 8 | Y | Y | Y | Y | Y | | | Y | Y | Y |
| 8 | Y | Y | Y | Y | Y | | Y | | Y | Y |
| 8 | Y | Y | Y | Y | | Y | Y | Y | Y | |
| 8 | Y | Y | Y | Y | | Y | Y | Y | | Y |
| 8 | Y | Y | Y | Y | | Y | Y | | Y | Y |
| 8 | Y | Y | Y | Y | | | Y | Y | Y | Y |
| 8 | Y | Y | Y | | Y | Y | Y | Y | Y | |
| 8 | Y | Y | Y | | Y | Y | Y | Y | | Y |
| 8 | Y | Y | Y | | Y | Y | | Y | Y | Y |
| 8 | Y | Y | Y | | Y | | Y | Y | Y | Y |
| 8 | Y | Y | Y | | | Y | Y | Y | Y | Y |
| 8 | Y | Y | | Y | Y | Y | Y | Y | Y | |
| 8 | Y | Y | | Y | Y | Y | Y | Y | | Y |
| 8 | Y | Y | | Y | Y | Y | Y | | Y | Y |
| 8 | Y | Y | | Y | Y | Y | | Y | Y | Y |
| 8 | Y | Y | | Y | Y | | Y | Y | Y | Y |
| 8 | Y | Y | | Y | | Y | Y | Y | Y | Y |
| 8 | Y | Y | | | Y | Y | Y | Y | Y | Y |
| 8 | Y | | Y | Y | Y | Y | Y | Y | Y | |
| 8 | Y | | Y | Y | Y | Y | Y | Y | | Y |
| 8 | Y | | Y | Y | Y | Y | Y | | Y | Y |
| 8 | Y | | Y | Y | Y | Y | | Y | Y | Y |
| 8 | Y | | Y | Y | Y | | Y | Y | Y | Y |
| 8 | Y | | Y | Y | | Y | Y | Y | Y | Y |
| 8 | Y | | Y | | Y | Y | Y | Y | Y | Y |
| 8 | | Y | Y | Y | Y | Y | Y | Y | Y | |
| 8 | | Y | Y | Y | Y | Y | Y | Y | | Y |
| 8 | | Y | Y | Y | Y | Y | Y | | Y | Y |
| 8 | | Y | Y | Y | Y | Y | | Y | Y | Y |
| 8 | | Y | Y | Y | Y | | Y | Y | Y | Y |
| 8 | | Y | Y | Y | | Y | Y | Y | Y | Y |
| 8 | | Y | Y | | Y | Y | Y | Y | Y | Y |
| 7 | Y | Y | Y | Y | Y | Y | Y | | | |
| 7 | Y | Y | Y | Y | Y | Y | Y | Y | | |
| 7 | Y | Y | Y | Y | Y | Y | Y | | Y | |
| 7 | Y | Y | Y | Y | Y | Y | Y | | | Y |
| 7 | Y | Y | Y | Y | Y | Y | | Y | Y | |
| 7 | Y | Y | Y | Y | Y | Y | | Y | | |
| 7 | Y | Y | Y | Y | Y | Y | | Y | | Y |
| 7 | Y | Y | Y | Y | Y | | | Y | Y | |
| 7 | Y | Y | Y | Y | Y | | | Y | | Y |
| 7 | Y | Y | Y | Y | Y | | | | Y | Y |
| 7 | Y | Y | Y | Y | | | Y | Y | Y | |
| 7 | Y | Y | Y | Y | | | Y | Y | | Y |
| 7 | Y | Y | Y | Y | | | Y | | Y | Y |
| 7 | Y | Y | Y | Y | | Y | | | Y | Y |
| 7 | Y | Y | Y | Y | Y | | | | | Y |
| 7 | Y | Y | Y | Y | | | | Y | Y | Y |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium 2_1_58FAA* | clade_537 *Ruminococcus bromii* | clade_478 *Subdoligranulum variabile* |
| 7 | Y | Y | Y | Y | | | Y | Y | | Y |
| 7 | Y | Y | Y | Y | | | Y | | Y | Y |
| 7 | Y | Y | Y | Y | | | | Y | Y | Y |
| 7 | Y | Y | Y | | Y | Y | Y | Y | | |
| 7 | Y | Y | Y | | Y | Y | Y | | Y | |
| 7 | Y | Y | Y | | Y | Y | Y | | | Y |
| 7 | Y | Y | Y | | Y | Y | | Y | Y | |
| 7 | Y | Y | Y | | Y | Y | | Y | | Y |
| 7 | Y | Y | Y | | Y | Y | | | Y | Y |
| 7 | Y | Y | Y | | Y | | Y | Y | Y | |
| 7 | Y | Y | Y | | Y | | Y | Y | | Y |
| 7 | Y | Y | Y | | Y | | Y | | Y | Y |
| 7 | Y | Y | Y | | Y | | | Y | Y | Y |
| 7 | Y | Y | Y | | | Y | Y | Y | Y | |
| 7 | Y | Y | Y | | | Y | Y | Y | | Y |
| 7 | Y | Y | Y | | | Y | Y | | Y | Y |
| 7 | Y | Y | Y | | | Y | | Y | Y | Y |
| 7 | Y | Y | | Y | Y | Y | Y | Y | | |
| 7 | Y | Y | | Y | Y | Y | Y | | | Y |
| 7 | Y | Y | | Y | Y | Y | | Y | Y | |
| 7 | Y | Y | | Y | Y | Y | | Y | | Y |
| 7 | Y | Y | | Y | Y | Y | | | Y | Y |
| 7 | Y | Y | | Y | Y | | Y | Y | Y | |
| 7 | Y | Y | | Y | Y | | Y | Y | | Y |
| 7 | Y | Y | | Y | Y | | Y | | Y | Y |
| 7 | Y | Y | | Y | Y | | | Y | Y | Y |
| 7 | Y | Y | | Y | | Y | Y | Y | Y | |
| 7 | Y | Y | | Y | | Y | Y | Y | | Y |
| 7 | Y | Y | | Y | | Y | Y | | Y | Y |
| 7 | Y | Y | | Y | | Y | | Y | Y | Y |
| 7 | Y | Y | | Y | | | Y | Y | Y | Y |
| 7 | Y | Y | | | Y | Y | Y | Y | Y | |
| 7 | Y | Y | | | Y | Y | Y | Y | | Y |
| 7 | Y | Y | | | Y | Y | Y | | Y | Y |
| 7 | Y | Y | | | Y | Y | | Y | Y | Y |
| 7 | Y | Y | | | Y | | Y | Y | Y | Y |
| 7 | Y | Y | | | | Y | Y | Y | Y | Y |
| 7 | Y | | Y | Y | Y | Y | Y | Y | | |
| 7 | Y | | Y | Y | Y | Y | Y | | Y | |
| 7 | Y | | Y | Y | Y | Y | Y | | | Y |
| 7 | Y | | Y | Y | Y | Y | | Y | Y | |
| 7 | Y | | Y | Y | Y | Y | | Y | | Y |
| 7 | Y | | Y | Y | Y | Y | | | Y | Y |
| 7 | Y | | Y | Y | Y | | Y | Y | Y | |
| 7 | Y | | Y | Y | Y | | Y | Y | | Y |
| 7 | Y | | Y | Y | Y | | Y | | Y | Y |
| 7 | Y | | Y | Y | Y | | | Y | Y | Y |
| 7 | Y | | Y | Y | | Y | Y | Y | Y | |
| 7 | Y | | Y | Y | | Y | Y | Y | | Y |
| 7 | Y | | Y | Y | | Y | Y | | Y | Y |
| 7 | Y | | Y | Y | | Y | | Y | Y | Y |
| 7 | Y | | Y | Y | | | Y | Y | Y | Y |
| 7 | Y | | Y | | Y | Y | Y | Y | Y | |
| 7 | Y | | Y | | Y | Y | Y | Y | | Y |
| 7 | Y | | Y | | Y | Y | Y | | Y | Y |
| 7 | Y | | Y | | Y | Y | | Y | Y | Y |
| 7 | Y | | Y | | Y | | Y | Y | Y | Y |
| 7 | Y | | | Y | Y | Y | Y | Y | Y | |
| 7 | Y | | | Y | Y | Y | Y | Y | | Y |
| 7 | | Y | Y | Y | Y | Y | Y | | Y | |
| 7 | | Y | Y | Y | Y | Y | Y | | | Y |
| 7 | | Y | Y | Y | Y | Y | | Y | Y | |
| 7 | | Y | Y | Y | Y | Y | | | Y | Y |
| 7 | | Y | Y | Y | Y | | | Y | Y | Y |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium* 2_1_58FAA | clade_537 *Ruminococcus bromii* | clade_478 *Subdoligranulum variabile* |
| 7 |   | Y | Y | Y | Y |   | Y | Y | Y |   |
| 7 |   | Y | Y | Y | Y |   | Y |   | Y | Y |
| 7 |   | Y | Y | Y | Y |   |   | Y | Y | Y |
| 7 |   | Y | Y | Y |   | Y | Y | Y | Y |   |
| 7 |   | Y | Y | Y |   | Y | Y |   |   | Y |
| 7 |   | Y | Y | Y |   |   | Y | Y | Y | Y |
| 7 |   | Y | Y | Y |   |   | Y | Y | Y | Y |
| 7 |   | Y | Y |   | Y | Y | Y | Y | Y |   |
| 7 |   | Y | Y |   | Y | Y | Y | Y |   | Y |
| 7 |   | Y | Y |   | Y | Y |   |   | Y | Y |
| 7 |   | Y | Y |   | Y |   | Y | Y | Y | Y |
| 7 |   | Y | Y |   |   | Y | Y | Y | Y | Y |
| 7 |   | Y |   | Y | Y | Y | Y | Y | Y |   |
| 7 |   | Y |   | Y | Y | Y | Y | Y |   | Y |
| 7 |   | Y |   | Y | Y | Y |   | Y | Y | Y |
| 7 |   | Y |   | Y | Y |   | Y | Y | Y | Y |
| 7 |   | Y |   | Y |   | Y | Y | Y | Y | Y |
| 7 |   | Y |   |   | Y | Y | Y | Y | Y | Y |
| 7 |   |   | Y | Y | Y | Y | Y | Y | Y |   |
| 7 |   |   | Y | Y | Y | Y | Y |   | Y | Y |
| 7 |   |   | Y | Y | Y | Y |   | Y | Y | Y |
| 7 |   |   | Y | Y | Y |   | Y | Y | Y | Y |
| 7 |   |   | Y | Y |   | Y | Y | Y | Y | Y |
| 7 |   |   | Y |   | Y | Y | Y | Y | Y | Y |
| 7 |   |   |   | Y | Y | Y | Y | Y | Y | Y |
| 6 | Y | Y | Y | Y | Y | Y |   |   |   |   |
| 6 | Y | Y | Y | Y | Y |   | Y |   |   |   |
| 6 | Y | Y | Y | Y | Y |   |   | Y |   |   |
| 6 | Y | Y | Y | Y | Y |   |   |   | Y |   |
| 6 | Y | Y | Y | Y | Y |   |   |   |   | Y |
| 6 | Y | Y | Y | Y |   | Y | Y |   |   |   |
| 6 | Y | Y | Y | Y |   | Y |   | Y |   |   |
| 6 | Y | Y | Y | Y |   | Y |   |   | Y |   |
| 6 | Y | Y | Y | Y |   | Y |   |   |   | Y |
| 6 | Y | Y | Y | Y |   |   | Y | Y |   |   |
| 6 | Y | Y | Y | Y |   |   | Y |   | Y |   |
| 6 | Y | Y | Y | Y |   |   | Y |   |   | Y |
| 6 | Y | Y | Y | Y |   |   |   | Y | Y |   |
| 6 | Y | Y | Y | Y |   |   |   | Y |   | Y |
| 6 | Y | Y | Y | Y |   |   |   |   | Y | Y |
| 6 | Y | Y | Y |   | Y | Y | Y |   |   |   |
| 6 | Y | Y | Y |   | Y | Y |   | Y |   |   |
| 6 | Y | Y | Y |   | Y | Y |   |   | Y |   |
| 6 | Y | Y | Y |   | Y | Y |   |   |   | Y |
| 6 | Y | Y | Y |   | Y |   | Y | Y |   |   |
| 6 | Y | Y | Y |   | Y |   | Y |   | Y |   |
| 6 | Y | Y | Y |   | Y |   | Y |   |   | Y |
| 6 | Y | Y | Y |   | Y |   |   | Y | Y |   |
| 6 | Y | Y | Y |   | Y |   |   | Y |   | Y |
| 6 | Y | Y | Y |   | Y |   |   |   | Y | Y |

TABLE 13-continued

| | OTU Clade: | | | | | | | | |
|---|---|---|---|---|---|---|---|---|---|
| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
| 6 | Y | Y | | Y | Y | | | Y | | Y |
| 6 | Y | Y | | Y | Y | | | | Y | Y |
| 6 | Y | Y | | Y | | Y | Y | Y | | |
| 6 | Y | Y | | Y | | Y | Y | | Y | |
| 6 | Y | Y | | Y | | Y | Y | | | Y |
| 6 | Y | Y | | Y | | Y | | Y | Y | |
| 6 | Y | Y | | Y | | Y | | Y | | Y |
| 6 | Y | Y | | Y | | Y | | | Y | Y |
| 6 | Y | Y | | Y | | | Y | Y | Y | |
| 6 | Y | Y | | Y | | | Y | | | Y |
| 6 | Y | Y | | Y | | | Y | | Y | Y |
| 6 | Y | Y | | Y | | | | Y | Y | Y |
| 6 | Y | Y | | | Y | Y | Y | Y | | |
| 6 | Y | Y | | | Y | Y | Y | | | Y |
| 6 | Y | Y | | | Y | Y | | Y | Y | |
| 6 | Y | Y | | | Y | Y | | Y | | Y |
| 6 | Y | Y | | | Y | Y | | | Y | Y |
| 6 | Y | Y | | | Y | | Y | Y | Y | |
| 6 | Y | Y | | | Y | | Y | Y | | Y |
| 6 | Y | Y | | | Y | | Y | | Y | Y |
| 6 | Y | Y | | | Y | | | Y | Y | Y |
| 6 | Y | Y | | | | Y | Y | Y | Y | |
| 6 | Y | Y | | | | Y | Y | | | Y |
| 6 | Y | Y | | | | Y | Y | | Y | Y |
| 6 | Y | Y | | | | Y | | Y | Y | Y |
| 6 | Y | Y | | | | | Y | Y | Y | Y |
| 6 | Y | | Y | Y | Y | Y | Y | Y | | |
| 6 | Y | | Y | Y | Y | Y | Y | | Y | |
| 6 | Y | | Y | Y | Y | Y | | | | Y |
| 6 | Y | | Y | Y | Y | | Y | Y | Y | |
| 6 | Y | | Y | Y | Y | | Y | | Y | |
| 6 | Y | | Y | Y | Y | | Y | | | Y |
| 6 | Y | | Y | Y | Y | | | Y | Y | Y |
| 6 | Y | | Y | Y | Y | | | | Y | Y |
| 6 | Y | | Y | Y | | Y | Y | Y | | |
| 6 | Y | | Y | Y | | Y | Y | Y | | Y |
| 6 | Y | | Y | Y | | Y | Y | | | Y |
| 6 | Y | | Y | Y | | Y | | Y | Y | |
| 6 | Y | | Y | Y | | Y | | Y | | Y |
| 6 | Y | | Y | Y | | Y | | | Y | Y |
| 6 | Y | | Y | Y | | | Y | Y | Y | |
| 6 | Y | | Y | Y | | | Y | Y | | Y |
| 6 | Y | | Y | Y | | | Y | | Y | Y |
| 6 | Y | | Y | Y | | | | Y | Y | Y |
| 6 | Y | | Y | | Y | Y | Y | Y | | |
| 6 | Y | | Y | | Y | Y | Y | | Y | |
| 6 | Y | | Y | | Y | Y | Y | | | Y |
| 6 | Y | | Y | | Y | Y | | Y | Y | |
| 6 | Y | | Y | | Y | Y | | | Y | Y |
| 6 | Y | | Y | | Y | | Y | Y | Y | |
| 6 | Y | | Y | | Y | | Y | Y | | Y |
| 6 | Y | | Y | | Y | | Y | | Y | Y |
| 6 | Y | | Y | | Y | | | Y | Y | Y |
| 6 | Y | | Y | | | Y | Y | Y | Y | |
| 6 | Y | | Y | | | Y | Y | Y | | Y |
| 6 | Y | | Y | | | Y | Y | | Y | Y |
| 6 | Y | | Y | | | Y | | Y | Y | Y |
| 6 | Y | | Y | | | | Y | Y | Y | Y |
| 6 | Y | | | Y | Y | Y | Y | Y | Y | |
| 6 | Y | | | Y | Y | Y | Y | Y | | Y |
| 6 | Y | | | Y | Y | Y | Y | | Y | Y |
| 6 | Y | | | Y | Y | Y | | Y | Y | |
| 6 | Y | | | Y | Y | Y | | Y | | Y |
| 6 | Y | | | Y | Y | | Y | Y | | Y |
| 6 | Y | | | Y | Y | | Y | Y | Y | Y |
| 6 | Y | | | Y | Y | | | Y | Y | Y |
| 6 | Y | | | Y | | Y | Y | Y | Y | |

TABLE 13-continued

| | OTU Clade: | | | | | | | | | |
|---|---|---|---|---|---|---|---|---|---|---|
| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
| 6 | Y | | | Y | | Y | Y | Y | | Y |
| 6 | Y | | | Y | | Y | | Y | Y | Y |
| 6 | Y | | | Y | | | Y | Y | Y | Y |
| 6 | Y | | | | Y | Y | Y | Y | Y | |
| 6 | Y | | | | Y | Y | Y | Y | | Y |
| 6 | Y | | | | Y | Y | Y | | Y | Y |
| 6 | Y | | | | Y | Y | | Y | Y | Y |
| 6 | Y | | | | Y | | Y | Y | Y | Y |
| 6 | Y | | | | Y | | Y | Y | Y | Y |
| 6 | | Y | Y | Y | Y | Y | Y | Y | | |
| 6 | | Y | Y | Y | Y | Y | Y | | Y | |
| 6 | | Y | Y | Y | Y | Y | | | | Y |
| 6 | | Y | Y | Y | Y | | Y | Y | | |
| 6 | | Y | Y | Y | Y | | Y | | Y | |
| 6 | | Y | Y | Y | Y | | Y | | | Y |
| 6 | | Y | Y | Y | Y | | | Y | Y | |
| 6 | | Y | Y | Y | Y | | | Y | | Y |
| 6 | | Y | Y | Y | Y | | | | Y | Y |
| 6 | | Y | Y | Y | | Y | Y | Y | | |
| 6 | | Y | Y | Y | | Y | Y | | Y | |
| 6 | | Y | Y | Y | | Y | Y | | | Y |
| 6 | | Y | Y | Y | | Y | | Y | Y | |
| 6 | | Y | Y | Y | | Y | | Y | | Y |
| 6 | | Y | Y | Y | | Y | | | Y | Y |
| 6 | | Y | Y | Y | | | Y | Y | | Y |
| 6 | | Y | Y | Y | | | Y | | Y | Y |
| 6 | | Y | Y | Y | | | | Y | Y | Y |
| 6 | | Y | Y | | Y | Y | Y | Y | Y | |
| 6 | | Y | Y | | Y | Y | Y | Y | | Y |
| 6 | | Y | Y | | Y | Y | Y | | Y | Y |
| 6 | | Y | Y | | Y | Y | | Y | Y | |
| 6 | | Y | Y | | Y | Y | | Y | | Y |
| 6 | | Y | Y | | Y | Y | | | Y | Y |
| 6 | | Y | Y | | Y | | Y | Y | Y | |
| 6 | | Y | Y | | Y | | Y | Y | | Y |
| 6 | | Y | Y | | Y | | Y | | Y | Y |
| 6 | | Y | Y | | Y | | | Y | Y | Y |
| 6 | | Y | Y | | | Y | Y | Y | Y | |
| 6 | | Y | Y | | | Y | Y | Y | | Y |
| 6 | | Y | Y | | | Y | Y | | Y | Y |
| 6 | | Y | Y | | | Y | | Y | Y | Y |
| 6 | | Y | Y | | | | Y | Y | Y | Y |
| 6 | | Y | | Y | Y | Y | Y | Y | | |
| 6 | | Y | | Y | Y | Y | Y | | Y | |
| 6 | | Y | | Y | Y | Y | Y | | | Y |
| 6 | | Y | | Y | Y | Y | | Y | Y | |
| 6 | | Y | | Y | Y | Y | | Y | | Y |
| 6 | | Y | | Y | Y | Y | | | Y | Y |
| 6 | | Y | | Y | Y | | Y | Y | Y | |
| 6 | | Y | | Y | Y | | Y | Y | | Y |
| 6 | | Y | | Y | Y | | Y | | Y | Y |
| 6 | | Y | | Y | Y | | | Y | Y | Y |
| 6 | | Y | | Y | | Y | Y | Y | Y | |
| 6 | | Y | | Y | | Y | Y | Y | | Y |
| 6 | | Y | | Y | | Y | Y | | Y | Y |
| 6 | | Y | | Y | | Y | | Y | Y | Y |
| 6 | | Y | | Y | | | Y | Y | Y | Y |
| 6 | | Y | | | Y | Y | Y | Y | Y | |
| 6 | | Y | | | Y | Y | Y | Y | | Y |
| 6 | | Y | | | Y | Y | Y | | Y | Y |
| 6 | | Y | | | Y | Y | | Y | Y | Y |
| 6 | | Y | | | Y | | Y | Y | Y | Y |
| 6 | | Y | | | | Y | Y | Y | Y | Y |
| 6 | | | Y | Y | Y | Y | Y | Y | | |
| 6 | | | Y | Y | Y | Y | Y | | Y | |
| 6 | | | Y | Y | Y | Y | Y | | | Y |
| 6 | | | Y | Y | Y | Y | | Y | Y | |
| 6 | | | Y | Y | Y | Y | | Y | | Y |
| 6 | | | Y | Y | Y | Y | | | Y | Y |
| 6 | | | Y | Y | Y | | Y | Y | Y | |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium* 2_1_58FAA | clade_537 *Ruminococcus bromii* | clade_478 *Subdoligranulum variabile* |
| 6 | | | Y | Y | Y | | Y | Y | | Y |
| 6 | | | Y | Y | Y | | Y | | Y | Y |
| 6 | | | Y | Y | | Y | Y | Y | Y | |
| 6 | | | Y | Y | | Y | Y | Y | | Y |
| 6 | | | Y | Y | | Y | Y | | Y | Y |
| 6 | | | Y | Y | | Y | | Y | Y | Y |
| 6 | | | Y | Y | | | Y | Y | Y | Y |
| 6 | | | Y | | Y | Y | Y | Y | Y | |
| 6 | | | Y | | Y | Y | Y | Y | | Y |
| 6 | | | Y | | Y | Y | Y | | Y | Y |
| 6 | | | Y | | Y | Y | | Y | Y | Y |
| 6 | | | Y | | | Y | Y | Y | Y | Y |
| 6 | | | | Y | Y | Y | Y | Y | Y | |
| 6 | | | | Y | Y | Y | Y | Y | | Y |
| 6 | | | | Y | Y | Y | Y | | Y | Y |
| 6 | | | | Y | Y | Y | | Y | Y | Y |
| 6 | | | | Y | Y | | Y | Y | Y | Y |
| 6 | | | | Y | | Y | Y | Y | Y | Y |
| 5 | Y | Y | Y | Y | Y | | | | | |
| 5 | Y | Y | Y | Y | | | Y | | | |
| 5 | Y | Y | Y | Y | | | | Y | | |
| 5 | Y | Y | Y | Y | | | | | Y | |
| 5 | Y | Y | Y | Y | | | | | | Y |
| 5 | Y | Y | Y | | Y | Y | | | | |
| 5 | Y | Y | Y | | Y | | Y | | | |
| 5 | Y | Y | Y | | Y | | | Y | | |
| 5 | Y | Y | Y | | Y | | | | Y | |
| 5 | Y | Y | Y | | Y | | | | | Y |
| 5 | Y | Y | Y | | | Y | Y | | | |
| 5 | Y | Y | Y | | | Y | | Y | | |
| 5 | Y | Y | Y | | | Y | | | Y | |
| 5 | Y | Y | Y | | | Y | | | | Y |
| 5 | Y | Y | Y | | | | Y | Y | | |
| 5 | Y | Y | Y | | | | Y | | Y | |
| 5 | Y | Y | Y | | | | Y | | | Y |
| 5 | Y | Y | Y | | | | | Y | Y | |
| 5 | Y | Y | Y | | | | | Y | | Y |
| 5 | Y | Y | Y | | | | | | Y | Y |
| 5 | Y | Y | | Y | Y | Y | | | | |
| 5 | Y | Y | | Y | Y | | Y | | | |
| 5 | Y | Y | | Y | Y | | | Y | | |
| 5 | Y | Y | | Y | Y | | | | Y | |
| 5 | Y | Y | | Y | Y | | | | | Y |
| 5 | Y | Y | | Y | | Y | Y | | | |
| 5 | Y | Y | | Y | | Y | | Y | | |
| 5 | Y | Y | | Y | | Y | | | Y | |
| 5 | Y | Y | | Y | | Y | | | | Y |
| 5 | Y | Y | | Y | | | Y | Y | | |
| 5 | Y | Y | | Y | | | Y | | Y | |
| 5 | Y | Y | | Y | | | Y | | | Y |
| 5 | Y | Y | | Y | | | | Y | Y | |
| 5 | Y | Y | | Y | | | | Y | | Y |
| 5 | Y | Y | | Y | | | | | Y | Y |
| 5 | Y | Y | | | Y | Y | Y | | | |
| 5 | Y | Y | | | Y | Y | | Y | | |
| 5 | Y | Y | | | Y | Y | | | Y | |
| 5 | Y | Y | | | Y | Y | | | | Y |
| 5 | Y | Y | | | Y | | Y | Y | | |
| 5 | Y | Y | | | Y | | Y | | Y | |
| 5 | Y | Y | | | Y | | Y | | | Y |
| 5 | Y | Y | | | Y | | | Y | Y | |
| 5 | Y | Y | | | Y | | | Y | | Y |
| 5 | Y | Y | | | Y | | | | Y | Y |
| 5 | Y | Y | | | | Y | Y | Y | | |
| 5 | Y | Y | | | | Y | Y | | Y | |
| 5 | Y | Y | | | | Y | Y | | | Y |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium* 2_1_58FAA | clade_537 *Ruminococcus bromii* | clade_478 *Subdoligranulum variabile* |
| 5 | Y | Y | | | | | Y | Y | Y | |
| 5 | Y | Y | | | | | Y | Y | | Y |
| 5 | Y | Y | | | | | Y | | Y | Y |
| 5 | Y | Y | | | | | | Y | Y | Y |
| 5 | Y | | Y | Y | Y | Y | | | | |
| 5 | Y | | Y | Y | Y | | Y | | | |
| 5 | Y | | Y | Y | Y | | | Y | | |
| 5 | Y | | Y | Y | Y | | | | Y | |
| 5 | Y | | Y | Y | Y | | | | | Y |
| 5 | Y | | Y | Y | | Y | Y | | | |
| 5 | Y | | Y | Y | | Y | | Y | | |
| 5 | Y | | Y | Y | | Y | | | Y | |
| 5 | Y | | Y | Y | | Y | | | | Y |
| 5 | Y | | Y | Y | | | Y | Y | | |
| 5 | Y | | Y | Y | | | Y | | Y | |
| 5 | Y | | Y | Y | | | Y | | | Y |
| 5 | Y | | Y | Y | | | | Y | Y | |
| 5 | Y | | Y | Y | | | | Y | | Y |
| 5 | Y | | Y | Y | | | | | Y | Y |
| 5 | Y | | Y | | Y | Y | Y | Y | | |
| 5 | Y | | Y | | Y | Y | Y | | Y | |
| 5 | Y | | Y | | Y | Y | | | | Y |
| 5 | Y | | Y | | Y | | Y | Y | | |
| 5 | Y | | Y | | Y | | Y | | Y | |
| 5 | Y | | Y | | Y | | Y | | | Y |
| 5 | Y | | Y | | Y | | | Y | Y | |
| 5 | Y | | Y | | Y | | | | Y | Y |
| 5 | Y | | Y | | Y | | | | Y | Y |
| 5 | Y | | Y | | | Y | Y | Y | | |
| 5 | Y | | Y | | | Y | Y | Y | | Y |
| 5 | Y | | Y | | | Y | Y | | Y | Y |
| 5 | Y | | Y | | | | Y | Y | Y | |
| 5 | Y | | Y | | | | Y | Y | | Y |
| 5 | Y | | Y | | | | Y | | Y | Y |
| 5 | Y | | Y | | | | | Y | Y | Y |
| 5 | Y | | | Y | Y | Y | Y | | | |
| 5 | Y | | | Y | Y | Y | | Y | | |
| 5 | Y | | | Y | Y | Y | | | Y | |
| 5 | Y | | | Y | Y | Y | | | | Y |
| 5 | Y | | | Y | Y | | Y | Y | | |
| 5 | Y | | | Y | Y | | Y | | Y | |
| 5 | Y | | | Y | Y | | Y | | | Y |
| 5 | Y | | | Y | Y | | | Y | Y | |
| 5 | Y | | | Y | Y | | | Y | | Y |
| 5 | Y | | | Y | Y | | | | Y | Y |
| 5 | Y | | | Y | | Y | Y | Y | | |
| 5 | Y | | | Y | | Y | Y | | Y | |
| 5 | Y | | | Y | | Y | | Y | Y | |
| 5 | Y | | | Y | | Y | | Y | Y | Y |
| 5 | Y | | | Y | | | Y | Y | Y | Y |
| 5 | Y | | | Y | | | Y | | Y | Y |
| 5 | Y | | | Y | | | | Y | Y | Y |
| 5 | Y | | | | Y | Y | Y | Y | | |
| 5 | Y | | | | Y | Y | Y | | Y | |
| 5 | Y | | | | Y | Y | Y | | | Y |
| 5 | Y | | | | Y | Y | | Y | Y | |
| 5 | Y | | | | Y | Y | | Y | | Y |
| 5 | Y | | | | Y | Y | | | Y | Y |
| 5 | Y | | | | Y | | Y | Y | Y | |
| 5 | Y | | | | Y | | Y | Y | | Y |
| 5 | Y | | | | Y | | Y | | Y | Y |
| 5 | Y | | | | Y | | | Y | Y | Y |
| 5 | Y | | | | | Y | Y | Y | Y | |
| 5 | Y | | | | | Y | Y | Y | | Y |
| 5 | Y | | | | | Y | Y | | Y | Y |
| 5 | Y | | | | | Y | | Y | Y | Y |
| 5 | Y | | | | | | Y | Y | Y | Y |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium* 2_1_58FAA | clade_537 *Ruminococcus bromii* | clade_478 *Subdoligranulum variabile* |
| 5 | Y | | | | | | Y | Y | Y | Y |
| 5 | | Y | Y | Y | Y | Y | Y | | | |
| 5 | | Y | Y | Y | Y | | | Y | | |
| 5 | | Y | Y | Y | Y | | | | Y | |
| 5 | | Y | Y | Y | Y | | | | | Y |
| 5 | | | | | | | | | | |
| 5 | | Y | Y | Y | | Y | Y | | | |
| 5 | | Y | Y | Y | | Y | | Y | | |
| 5 | | Y | Y | Y | | Y | | | Y | |
| 5 | | Y | Y | Y | | Y | | | | Y |
| 5 | | Y | Y | Y | | | Y | Y | | |
| 5 | | Y | Y | Y | | | Y | | Y | |
| 5 | | Y | Y | Y | | | Y | | | Y |
| 5 | | Y | Y | Y | | | | Y | Y | |
| 5 | | Y | Y | Y | | | | Y | | Y |
| 5 | | Y | Y | Y | | | | | Y | Y |
| 5 | | Y | Y | | Y | Y | Y | | | |
| 5 | | Y | Y | | Y | Y | | Y | | |
| 5 | | Y | Y | | Y | Y | | | Y | |
| 5 | | Y | Y | | Y | Y | | | | Y |
| 5 | | Y | Y | | Y | | Y | Y | | |
| 5 | | Y | Y | | Y | | Y | | Y | |
| 5 | | Y | Y | | Y | | Y | | | Y |
| 5 | | Y | Y | | Y | | | Y | Y | |
| 5 | | Y | Y | | Y | | | Y | | Y |
| 5 | | Y | Y | | Y | | | | Y | Y |
| 5 | | Y | Y | | | Y | Y | Y | | |
| 5 | | Y | Y | | | Y | Y | | Y | |
| 5 | | Y | Y | | | Y | Y | | | Y |
| 5 | | Y | Y | | | Y | | Y | Y | |
| 5 | | Y | Y | | | Y | | Y | | Y |
| 5 | | Y | Y | | | Y | | | Y | Y |
| 5 | | Y | Y | | | | Y | Y | Y | |
| 5 | | Y | Y | | | | Y | Y | | Y |
| 5 | | Y | Y | | | | Y | | Y | Y |
| 5 | | Y | Y | | | | | Y | Y | Y |
| 5 | | Y | | Y | Y | Y | Y | | | |
| 5 | | Y | | Y | Y | Y | | Y | | |
| 5 | | Y | | Y | Y | Y | | | Y | |
| 5 | | Y | | Y | Y | Y | | | | Y |
| 5 | | Y | | Y | Y | | Y | Y | | |
| 5 | | Y | | Y | Y | | Y | | Y | |
| 5 | | Y | | Y | Y | | Y | | | Y |
| 5 | | Y | | Y | Y | | | Y | Y | |
| 5 | | Y | | Y | Y | | | Y | | Y |
| 5 | | Y | | Y | Y | | | | Y | Y |
| 5 | | Y | | Y | | Y | Y | Y | | |
| 5 | | Y | | Y | | Y | Y | | Y | |
| 5 | | Y | | Y | | Y | Y | | | Y |
| 5 | | Y | | Y | | Y | | Y | Y | |
| 5 | | Y | | Y | | Y | | Y | | Y |
| 5 | | Y | | Y | | Y | | | Y | Y |
| 5 | | Y | | Y | | | Y | Y | Y | |
| 5 | | Y | | Y | | | Y | Y | | Y |
| 5 | | Y | | Y | | | Y | | Y | Y |
| 5 | | Y | | Y | | | | Y | Y | Y |
| 5 | | Y | | | Y | Y | Y | Y | | |
| 5 | | Y | | | Y | Y | Y | | Y | |
| 5 | | Y | | | Y | Y | Y | | | Y |
| 5 | | Y | | | Y | Y | | Y | Y | |
| 5 | | Y | | | Y | Y | | Y | | Y |
| 5 | | Y | | | Y | Y | | | Y | Y |
| 5 | | Y | | | Y | | Y | Y | Y | |
| 5 | | Y | | | Y | | Y | Y | | Y |
| 5 | | Y | | | Y | | Y | | Y | Y |
| 5 | | Y | | | Y | | | Y | Y | Y |
| 5 | | Y | | | | Y | Y | Y | Y | |
| 5 | | Y | | | | Y | Y | Y | | Y |
| 5 | | Y | | | | Y | Y | | Y | Y |
| 5 | | Y | | | | Y | | Y | Y | Y |
| 5 | | Y | | | | | Y | Y | Y | Y |
| 5 | | | Y | Y | Y | Y | Y | | | |

TABLE 13-continued

| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
|---|---|---|---|---|---|---|---|---|---|---|
| 5 | | | Y | Y | Y | Y | | Y | | |
| 5 | | | Y | Y | Y | Y | | | Y | |
| 5 | | | Y | Y | Y | Y | | | | Y |
| 5 | | | Y | Y | Y | | Y | Y | | |
| 5 | | | Y | Y | Y | | Y | | Y | |
| 5 | | | Y | Y | Y | | Y | | | Y |
| 5 | | | Y | Y | Y | | | Y | Y | |
| 5 | | | Y | Y | Y | | | Y | | Y |
| 5 | | | Y | Y | Y | | | | Y | Y |
| 5 | | | Y | Y | | Y | Y | Y | | |
| 5 | | | Y | Y | | Y | Y | | Y | |
| 5 | | | Y | Y | | Y | Y | | | Y |
| 5 | | | Y | Y | | Y | | Y | Y | |
| 5 | | | Y | Y | | Y | | Y | | Y |
| 5 | | | Y | Y | | Y | | | Y | Y |
| 5 | | | Y | Y | | | Y | Y | Y | |
| 5 | | | Y | Y | | | Y | Y | | Y |
| 5 | | | Y | Y | | | Y | | Y | Y |
| 5 | | | Y | Y | | | | Y | Y | Y |
| 5 | | | Y | | Y | Y | Y | Y | | |
| 5 | | | Y | | Y | Y | Y | | Y | |
| 5 | | | Y | | Y | Y | Y | | | Y |
| 5 | | | Y | | Y | Y | | Y | Y | |
| 5 | | | Y | | Y | Y | | Y | | Y |
| 5 | | | Y | | Y | Y | | | Y | Y |
| 5 | | | Y | | Y | | Y | Y | Y | |
| 5 | | | Y | | Y | | Y | Y | | Y |
| 5 | | | Y | | Y | | Y | | Y | Y |
| 5 | | | Y | | Y | | | Y | Y | Y |
| 5 | | | Y | | | Y | Y | Y | Y | |
| 5 | | | Y | | | Y | Y | Y | | Y |
| 5 | | | Y | | | Y | Y | | Y | Y |
| 5 | | | Y | | | Y | | Y | Y | Y |
| 5 | | | Y | | | | Y | Y | Y | Y |
| 5 | | | | Y | Y | Y | Y | Y | Y | |
| 5 | | | | Y | Y | Y | Y | | | Y |
| 5 | | | | Y | Y | Y | | Y | Y | |
| 5 | | | | Y | Y | Y | | | Y | Y |
| 5 | | | | Y | Y | | Y | Y | Y | |
| 5 | | | | Y | Y | | Y | Y | | Y |
| 5 | | | | Y | Y | | Y | | Y | Y |
| 5 | | | | Y | Y | | | Y | Y | Y |
| 5 | | | | Y | | Y | Y | Y | Y | |
| 5 | | | | Y | | Y | Y | Y | | Y |
| 5 | | | | Y | | Y | Y | | Y | Y |
| 5 | | | | Y | | Y | | Y | Y | Y |
| 5 | | | | Y | | | Y | Y | Y | Y |
| 5 | | | | | Y | Y | Y | Y | Y | |
| 5 | | | | | Y | Y | Y | Y | | Y |
| 5 | | | | | Y | Y | Y | | Y | Y |
| 5 | | | | | Y | Y | | Y | Y | Y |
| 5 | | | | | Y | | Y | Y | Y | Y |
| 5 | | | | | | Y | Y | Y | Y | Y |
| 4 | Y | Y | Y | Y | | | | | | |
| 4 | Y | Y | Y | | Y | | | | | |
| 4 | Y | Y | Y | | | Y | | | | |
| 4 | Y | Y | Y | | | | Y | | | |
| 4 | Y | Y | Y | | | | | Y | | |
| 4 | Y | Y | Y | | | | | | Y | |
| 4 | Y | Y | Y | | | | | | | Y |
| 4 | Y | Y | | Y | Y | | | | | |
| 4 | Y | Y | | Y | | Y | | | | |
| 4 | Y | Y | | Y | | | Y | | | |
| 4 | Y | Y | | Y | | | | Y | | |
| 4 | Y | Y | | Y | | | | | Y | |
| 4 | Y | Y | | Y | | | | | | Y |
| 4 | Y | Y | | | Y | Y | | | | |
| 4 | Y | Y | | | Y | | Y | | | |
| 4 | Y | Y | | | Y | | | Y | | |
| 4 | Y | Y | | | Y | | | | Y | |
| 4 | Y | Y | | | Y | | | | | Y |

TABLE 13-continued

| | OTU Clade: | | | | | | | | | |
|---|---|---|---|---|---|---|---|---|---|---|
| Num. of OTUs | clade_309 *Blautia luti* | clade_309 *Blautia schinkii* | clade_309 *Blautia* sp. M25 | clade_408 *Clostridium citroniae* | clade_537 *Clostridium leptum* | clade_444 *Eubacterium rectale* | clade_478 *Faecalibacterium prausnitzii* | clade_360 *Lachnospiraceae bacterium* 2_1_58FAA | clade_537 *Ruminococcus bromii* | clade_478 *Subdoligranulum variabile* |
| 4 | Y | Y | | | | | Y | Y | | |
| 4 | Y | Y | | | | | Y | | Y | |
| 4 | Y | Y | | | | | Y | | | Y |
| 4 | Y | Y | | | | | | Y | Y | |
| 4 | Y | Y | | | | | | Y | | Y |
| 4 | Y | Y | | | | | | | Y | Y |
| 4 | Y | Y | | | | | | Y | Y | |
| 4 | Y | Y | | | | | | Y | | Y |
| 4 | Y | | Y | Y | Y | | | | | |
| 4 | Y | | Y | Y | | Y | | | | |
| 4 | Y | | Y | Y | | | Y | | | |
| 4 | Y | | Y | Y | | | | Y | | |
| 4 | Y | | Y | Y | | | | | Y | |
| 4 | Y | | Y | Y | | | | | | Y |
| 4 | Y | | Y | | Y | Y | | | | |
| 4 | Y | | Y | | Y | | Y | | | |
| 4 | Y | | Y | | Y | | | Y | | |
| 4 | Y | | Y | | Y | | | | Y | |
| 4 | Y | | Y | | Y | | | | | Y |
| 4 | Y | | Y | | | Y | Y | | | |
| 4 | Y | | Y | | | Y | | Y | | |
| 4 | Y | | Y | | | Y | | | Y | |
| 4 | Y | | Y | | | Y | | | | Y |
| 4 | Y | | Y | | | | Y | Y | | |
| 4 | Y | | Y | | | | Y | | Y | |
| 4 | Y | | Y | | | | Y | | | Y |
| 4 | Y | | Y | | | | | Y | Y | |
| 4 | Y | | Y | | | | | Y | | Y |
| 4 | Y | | Y | | | | | | Y | Y |
| 4 | Y | | | Y | Y | Y | | | | |
| 4 | Y | | | Y | Y | | Y | | | |
| 4 | Y | | | Y | Y | | | Y | | |
| 4 | Y | | | Y | Y | | | | Y | |
| 4 | Y | | | Y | Y | | | | | Y |
| 4 | Y | | | Y | | Y | Y | | | |
| 4 | Y | | | Y | | Y | | Y | | |
| 4 | Y | | | Y | | Y | | | Y | |
| 4 | Y | | | Y | | Y | | | | Y |
| 4 | Y | | | Y | | | Y | Y | | |
| 4 | Y | | | Y | | | Y | | Y | |
| 4 | Y | | | Y | | | Y | | | Y |
| 4 | Y | | | Y | | | | Y | Y | |
| 4 | Y | | | Y | | | | Y | | Y |
| 4 | Y | | | Y | | | | | Y | Y |
| 4 | Y | | | | Y | Y | Y | | | |
| 4 | Y | | | | Y | Y | | Y | | |
| 4 | Y | | | | Y | Y | | | Y | |
| 4 | Y | | | | Y | Y | | | | Y |
| 4 | Y | | | | Y | | Y | Y | | |
| 4 | Y | | | | Y | | Y | | Y | |
| 4 | Y | | | | Y | | Y | | | Y |
| 4 | Y | | | | Y | | | Y | Y | |
| 4 | Y | | | | Y | | | Y | | Y |
| 4 | Y | | | | Y | | | | Y | Y |
| 4 | Y | | | | | Y | Y | Y | | |
| 4 | Y | | | | | Y | Y | | Y | |
| 4 | Y | | | | | Y | Y | | | Y |
| 4 | Y | | | | | Y | | Y | Y | |
| 4 | Y | | | | | Y | | Y | | Y |
| 4 | Y | | | | | Y | | | Y | Y |
| 4 | Y | | | | | | Y | Y | Y | |
| 4 | Y | | | | | | Y | Y | | Y |
| 4 | Y | | | | | | Y | | Y | Y |
| 4 | Y | | | | | | | Y | Y | Y |
| 4 | | Y | Y | Y | Y | | | | | |
| 4 | | Y | Y | Y | | Y | | | | |
| 4 | | Y | Y | Y | | | Y | | | |
| 4 | | Y | Y | Y | | | | Y | | |
| 4 | | Y | Y | Y | | | | | Y | |
| 4 | | Y | Y | Y | | | | | | Y |
| 4 | | Y | Y | | Y | Y | | | | |

TABLE 13-continued

| | OTU Clade: | | | | | | | | | |
|---|---|---|---|---|---|---|---|---|---|---|
| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
| 4 | Y | Y | | Y | | | Y | | | |
| 4 | Y | Y | | Y | | | | Y | | |
| 4 | Y | Y | | Y | | | | | Y | |
| 4 | Y | Y | | Y | | | | | | Y |
| 4 | Y | Y | | | | Y | Y | | | |
| 4 | Y | Y | | | | Y | | Y | | |
| 4 | Y | Y | | | | Y | | | Y | |
| 4 | Y | Y | | | | Y | | | | Y |
| 4 | Y | Y | | | | | Y | Y | | |
| 4 | Y | Y | | | | | Y | | Y | |
| 4 | Y | Y | | | | | Y | | | Y |
| 4 | Y | Y | | | | | | Y | Y | |
| 4 | Y | Y | | | | | | Y | | Y |
| 4 | Y | Y | | | | | | | Y | Y |
| 4 | Y | | Y | Y | Y | | | | | |
| 4 | Y | | Y | Y | Y | | | Y | | |
| 4 | Y | | Y | Y | Y | | | | Y | |
| 4 | Y | | Y | Y | Y | | | | | Y |
| 4 | Y | | Y | Y | | Y | Y | | | |
| 4 | Y | | Y | Y | | Y | | Y | | |
| 4 | Y | | Y | Y | | Y | | | Y | |
| 4 | Y | | Y | Y | | Y | | | | Y |
| 4 | Y | | Y | Y | | | Y | Y | | |
| 4 | Y | | Y | Y | | | Y | | Y | |
| 4 | Y | | Y | Y | | | Y | | | Y |
| 4 | Y | | Y | Y | | | | Y | Y | |
| 4 | Y | | Y | Y | | | | Y | | Y |
| 4 | Y | | Y | Y | | | | | Y | Y |
| 4 | Y | | Y | | Y | Y | Y | | | |
| 4 | Y | | Y | | Y | Y | | Y | | |
| 4 | Y | | Y | | Y | Y | | | Y | |
| 4 | Y | | Y | | Y | Y | | | | Y |
| 4 | Y | | Y | | Y | | Y | Y | | |
| 4 | Y | | Y | | Y | | Y | | Y | |
| 4 | Y | | Y | | Y | | Y | | | Y |
| 4 | Y | | Y | | Y | | | Y | Y | |
| 4 | Y | | Y | | Y | | | Y | | Y |
| 4 | Y | | Y | | Y | | | | Y | Y |
| 4 | Y | | Y | | | Y | Y | Y | | |
| 4 | Y | | Y | | | Y | Y | | Y | |
| 4 | Y | | Y | | | Y | Y | | | Y |
| 4 | Y | | Y | | | Y | | Y | Y | |
| 4 | Y | | Y | | | Y | | Y | | Y |
| 4 | Y | | Y | | | Y | | | Y | Y |
| 4 | Y | | Y | | | | Y | Y | Y | |
| 4 | Y | | Y | | | | Y | Y | | Y |
| 4 | Y | | Y | | | | Y | | Y | Y |
| 4 | Y | | Y | | | | | Y | Y | Y |
| 4 | | Y | Y | Y | Y | Y | | | | |
| 4 | | Y | Y | Y | Y | | | Y | | |
| 4 | | Y | Y | Y | Y | | | | Y | |
| 4 | | Y | Y | Y | Y | | | | | Y |
| 4 | | Y | Y | Y | | Y | Y | | | |
| 4 | | Y | Y | Y | | Y | | Y | | |
| 4 | | Y | Y | Y | | Y | | | Y | |
| 4 | | Y | Y | Y | | Y | | | | Y |
| 4 | | Y | Y | Y | | | Y | Y | | |
| 4 | | Y | Y | Y | | | Y | | Y | |
| 4 | | Y | Y | Y | | | Y | | | Y |
| 4 | | Y | Y | Y | | | | Y | Y | |
| 4 | | Y | Y | Y | | | | Y | | Y |
| 4 | | Y | Y | Y | | | | | Y | Y |
| 4 | | Y | Y | | Y | Y | Y | | | |
| 4 | | Y | Y | | Y | Y | | Y | | |
| 4 | | Y | Y | | Y | Y | | | Y | |
| 4 | | Y | Y | | Y | Y | | | | Y |
| 4 | | Y | Y | | Y | | Y | Y | | |
| 4 | | Y | Y | | Y | | Y | | Y | |
| 4 | | Y | Y | | Y | | Y | | | Y |
| 4 | | Y | Y | | Y | | | Y | Y | |
| 4 | | Y | Y | | Y | | | Y | | Y |

TABLE 13-continued

| Num. of OTUs | clade_309 Blautia luti | clade_309 Blautia schinkii | clade_309 Blautia sp. M25 | clade_408 Clostridium citroniae | clade_537 Clostridium leptum | clade_444 Eubacterium rectale | clade_478 Faecalibacterium prausnitzii | clade_360 Lachnospiraceae bacterium 2_1_58FAA | clade_537 Ruminococcus bromii | clade_478 Subdoligranulum variabile |
|---|---|---|---|---|---|---|---|---|---|---|
| 4 | | Y | | | Y | | | | Y | Y |
| 4 | | Y | | | | Y | Y | Y | | |
| 4 | | Y | | | | Y | Y | | Y | |
| 4 | | Y | | | | Y | Y | | | Y |
| 4 | | Y | | | | Y | | Y | Y | |
| 4 | | Y | | | | Y | | | Y | Y |
| 4 | | Y | | | | | Y | Y | Y | |
| 4 | | Y | | | | | Y | Y | | Y |
| 4 | | Y | | | | | Y | | Y | Y |
| 4 | | Y | | | | | | Y | Y | Y |
| 4 | | | | Y | Y | Y | Y | | | |
| 4 | | | | Y | Y | Y | | Y | | |
| 4 | | | | Y | Y | Y | | | Y | |
| 4 | | | | Y | Y | Y | | | | Y |
| 4 | | | | Y | Y | | Y | Y | | |
| 4 | | | | Y | Y | | Y | | Y | |
| 4 | | | | Y | Y | | Y | | | Y |
| 4 | | | | Y | Y | | | Y | Y | |
| 4 | | | | Y | Y | | | Y | | Y |
| 4 | | | | Y | Y | | | | Y | Y |
| 4 | | | | Y | | Y | Y | Y | | |
| 4 | | | | Y | | Y | Y | | Y | |
| 4 | | | | Y | | Y | Y | | | Y |
| 4 | | | | Y | | Y | | Y | Y | |
| 4 | | | | Y | | Y | | Y | | Y |
| 4 | | | | Y | | Y | | | Y | Y |
| 4 | | | | Y | | | Y | Y | Y | |
| 4 | | | | Y | | | Y | Y | | Y |
| 4 | | | | Y | | | Y | | Y | Y |
| 4 | | | | Y | | | | Y | Y | Y |
| 4 | | | | | Y | Y | Y | Y | | |
| 4 | | | | | Y | Y | Y | | Y | |
| 4 | | | | | Y | Y | Y | | | Y |
| 4 | | | | | Y | Y | | Y | Y | |
| 4 | | | | | Y | Y | | Y | | Y |
| 4 | | | | | Y | Y | | | Y | Y |
| 4 | | | | | Y | | Y | Y | Y | |
| 4 | | | | | Y | | Y | Y | | Y |
| 4 | | | | | Y | | Y | | Y | Y |
| 4 | | | | | Y | | | Y | Y | Y |
| 4 | | | | | | Y | Y | Y | Y | |
| 4 | | | | | | Y | Y | Y | | Y |
| 4 | | | | | | Y | Y | | Y | Y |
| 4 | | | | | | Y | | Y | Y | Y |
| 4 | | | | | | | Y | Y | Y | Y |

TABLE 14

Post-Treatment Ecologies

| OTU 1 | OTU 2 | OTU 3 | Percent of doses in which the ternary is present | Percent of post-treatment patients in which the ternary is present |
|---|---|---|---|---|
| Blautia sp. M25 | Faecalibacterium prausnitzii | Ruminococcus bromii | 100 | 75 |
| Blautia sp. M25 | Faecalibacterium prausnitzii | Ruminococcus obeum | 100 | 89 |
| Blautia sp. M25 | Faecalibacterium prausnitzii | Ruminococcus sp. 5_1_39BFAA | 100 | 89 |
| Blautia sp. M25 | Faecalibacterium prausnitzii | Ruminococcus torques | 100 | 93 |
| Blautia sp. M25 | Ruminococcus bromii | Ruminococcus obeum | 100 | 71 |
| Blautia sp. M25 | Ruminococcus bromii | Ruminococcus sp. 5_1_39BFAA | 100 | 71 |
| Blautia sp. M25 | Ruminococcus bromii | Ruminococcus torques | 100 | 75 |
| Blautia sp. M25 | Ruminococcus obeum | Ruminococcus sp. 5_1_39BFAA | 100 | 86 |

TABLE 14-continued

Post-Treatment Ecologies

| OTU 1 | OTU 2 | OTU 3 | Percent of doses in which the ternary is present | Percent of post-treatment patients in which the ternary is present |
|---|---|---|---|---|
| *Blautia* sp. M25 | *Ruminococcus obeum* | *Ruminococcus torques* | 100 | 89 |
| *Blautia* sp. M25 | *Ruminococcus* sp. 5_1_39BFAA | *Ruminococcus torques* | 100 | 89 |
| *Clostridium hathewayi* | *Clostridium orbiscindens* | *Escherichia coli* | 0 | 100 |
| *Clostridium hathewayi* | *Clostridium orbiscindens* | Lachnospiraceae bacterium 3_1_57FAA_CT1 | 0 | 100 |
| *Clostridium hathewayi* | *Clostridium orbiscindens* | *Ruminococcus torques* | 0 | 100 |
| *Clostridium hathewayi* | *Escherichia coli* | Lachnospiraceae bacterium 3_1_57FAA_CT1 | 0 | 100 |
| *Clostridium hathewayi* | *Escherichia coli* | *Ruminococcus torques* | 0 | 100 |
| *Clostridium orbiscindens* | *Escherichia coli* | Lachnospiraceae bacterium 3_1_57FAA_CT1 | 0 | 100 |
| *Clostridium orbiscindeas* | *Escherichia coli* | *Ruminococcus torques* | 0 | 100 |
| *Clostridium orbiscindens* | *Ruminococcus torques* | *Streptococcus salivarius* | 0 | 100 |
| *Faecalibacterium prausnitzii* | *Ruminococcus bromii* | *Ruminococcus obeum* | 100 | 75 |
| *Faecalibacterium prausnitzii* | *Ruminococcus bromii* | *Ruminococcus* sp. 5_1_39BFAA | 100 | 71 |
| *Faecalibacterium prausnitzii* | *Ruminococcus bromii* | *Ruminococcus torques* | 100 | 75 |
| *Faecalibacterium prausnitzii* | *Ruminococcus obeum* | *Ruminococcus* sp. 5_1_39BFAA | 100 | 86 |
| *Faecalibacterium prausnitzii* | *Ruminococcus obeum* | *Ruminococcus torques* | 100 | 93 |
| *Faecalibacterium prausnitzii* | *Ruminococcus* sp. 5_1_39BFAA | *Ruminococcus torques* | 100 | 89 |
| *Ruminococcus bromii* | *Ruminococcus obeum* | *Ruminococcus* sp. 5_1_9BFAA | 100 | 68 |
| *Ruminococcus bromii* | *Ruminococcus obeum* | *Ruminococcus torques* | 100 | 79 |
| *Ruminococcus bromii* | *Ruminococcus* sp. 5_1_39BFAA | *Ruminococcus torques* | 100 | 71 |
| *Ruminococcus obeum* | *Ruminococcus* sp. 5_1_39BFAA | *Ruminococcus torques* | 100 | 89 |

TABLE 15

Engrafting OTUs

| OTU 1 | OTU 2 | OTU 3 |
|---|---|---|
| *Blautia* sp. M25 | *Clostridiales* sp. SSC/2 | *Coprococcus catus* |
| *Blautia* sp. M25 | *Clostridiales* sp. SSC/2 | *Faecalibacterium prausnitzii* |
| *Blautia* sp. M25 | *Clostridiales* sp. SSC/2 | *Ruminococcus bromii* |
| *Blautia* sp. M25 | *Clostridiales* sp. SSC/2 | *Ruminococcus obeum* |
| *Blautia* sp. M25 | *Clostridiales* sp. SSC/2 | *Ruminococcus* sp. 5_1_39BFAA |
| *Blautia* sp. M25 | *Clostridiales* sp. SSC/2 | *Ruminococcus torques* |
| *Blautia* sp. M25 | *Coproeoceus catus* | *Faecalibacterium prausnitzii* |
| *Blautia* sp. M25 | *Coprococcus catus* | *Ruminococcus bromii* |
| *Blautia* sp. M25 | *Coproeoceus catus* | *Ruminococcus obeum* |
| *Blautia* sp. M25 | *Coprococcus catus* | *Ruminococcus* sp. 5_1_39BFAA |
| *Blautia* sp. M25 | *Coprococcus catus* | *Ruminococcus torques* |
| *Blautia* sp. M25 | *Eubacterium hallii* | *Faecalibacterium prausnitzii* |
| *Blautia* sp. M25 | *Eubacterium hallii* | *Ruminococcus bromii* |
| *Blautia* sp. M25 | *Eubacterium hallii* | *Ruminococcus obeum* |
| *Blautia* sp. M25 | *Eubacterium hallii* | *Ruminococcus* sp. 5_1_39BFAA |
| *Blautia* sp. M25 | *Eubacterium hallii* | *Ruminococcus torques* |
| *Blautia* sp. M25 | *Faecalibacterium prausnitzii* | *Gemmiger formicilis* |
| *Blautia* sp. M25 | *Gemmiger formicilis* | *Ruminococcus bromii* |
| *Blautia* sp. M25 | *Gemmiger formicilis* | *Ruminococcus obeum* |
| *Blautia* sp. M25 | *Gemmiger formicilis* | *Ruminococcus* sp. 5_1_39BFAA |
| *Blautia* sp. M25 | *Gemmiger formicilis* | *Ruminococcus torques* |
| *Clostridiales* sp. SSC/2 | *Coprococcus catus* | *Faecalibacterium prausnitzii* |

TABLE 15-continued

| Engrafting OTUs | | |
|---|---|---|
| OTU 1 | OTU 2 | OTU 3 |
| *Clostridiales* sp. SSC/2 | *Coprococcus catus* | *Ruminococcus bromii* |
| *Clostridiales* sp. SSC/2 | *Coprococcus catus* | *Ruminococcus obeum* |
| *Clostridiales* sp. SSC/2 | *Coprococcus catus* | *Ruminococcus* sp. 5_1_39BFAA |
| *Clostridiales* sp. SSC/2 | *Coprococcus catus* | *Ruminococcus torques* |
| *Clostridiales* sp. SSC/2 | *Faecalibacterium prausnitzii* | *Ruminococcus bromii* |
| *Clostridiales* sp. SSC/2 | *Faecalibacterium prausnitzii* | *Ruminococcus obeum* |
| *Clostridiales* sp. SSC/2 | *Faecalibacterium prausnitzii* | *Ruminococcus* sp. 5_1_39BFAA |
| *Clostridiales* sp. SSC/2 | *Faecalibacterium prausnitzii* | *Ruminococcus torques* |
| *Clostridiales* sp. SSC/2 | *Ruminococcus bromii* | *Ruminococcus obeum* |
| *Clostridiales* sp. SSC/2 | *Ruminococcus bromii* | *Ruminococcus* sp. 5_1_39BFAA |
| *Clostridiales* sp. SSC/2 | *Ruminococcus bromii* | *Ruminococcus torques* |
| *Clostridiales* sp. SSC/2 | *Ruminococcus obeum* | *Ruminococcus* sp. 5_1_39BFAA |
| *Clostridiales* sp. SSC/2 | *Ruminococcus obeum* | *Ruminococcus torques* |
| *Clostridiales* sp. SSC/2 | *Ruminococcus* sp. 5_1_39BFAA | *Ruminococcus torques* |
| *Coprococcus catus* | *Faecalibacterium prausnitzii* | *Ruminococcus bromii* |
| *Coprococcus catus* | *Faecalibacterium prausnitzii* | *Ruminococcus obeum* |
| *Coprococcus catus* | *Faecalibacterium prausnitzii* | *Ruminococcus* sp. 5_1_39BFAA |
| *Coprococcus catus* | *Faecalibacterium prausnitzii* | *Ruminococcus torques* |
| *Coprococcus catus* | *Ruminococcus bromii* | *Ruminococcus obeum* |
| *Coprococcus catus* | *Ruminococcus bromii* | *Ruminococcus* sp. 5_1_39BFAA |
| *Coprococcus catus* | *Ruminococcus bromii* | *Ruminococcus torques* |
| *Coprococcus catus* | *Ruminococcus obeum* | *Ruminococcus* sp. 5_1_39BFAA |
| *Coprococcus catus* | *Ruminococcus obeum* | *Ruminococcus torques* |
| *Coprococcus catus* | *Ruminococcus* sp. 5_1_39BFAA | *Ruminococcus torques* |
| *Eubacterium hallii* | *Faecalibacterium prausnitzii* | *Ruminococcus bromii* |
| *Eubacterium hallii* | *Faecalibacterium prausnitzii* | *Ruminococcus obeum* |
| *Eubacterium hallii* | *Faecalibacterium prausnitzii* | *Ruminococcus* sp. 5_1_39BFAA |
| *Eubacterium hallii* | *Faecalibacterium prausnitzii* | *Ruminococcus torques* |
| *Eubacterium hallii* | *Ruminococcus bromii* | *Ruminococcus obeum* |
| *Eubacterium hallii* | *Ruminococcus bromii* | *Ruminococcus* sp. 5_1_39BFAA |
| *Eubacterium hallii* | *Ruminococcus bromii* | *Ruminococcus torques* |
| *Eubacterium hallii* | *Ruminococcus obeum* | *Ruminococcus* sp. 5_1_39BFAA |
| *Eubacterium hallii* | *Ruminococcus obeum* | *Ruminococcus torques* |
| *Eubacterium hallii* | *Ruminococcus* sp. 5_1_39BFAA | *Ruminococcus torques* |
| *Faecalibacterium prausnitzii* | *Gemmiger formicilis* | *Ruminococcus bromii* |
| *Faecalibacterium prausnitzii* | *Gemmiger formicilis* | *Ruminococcus obeum* |
| *Faecalibacterium prausnitzii* | *Gemmiger formicilis* | *Ruminococcus* sp. 5_1_39BFAA |
| *Faecalibacterium prausnitzii* | *Gemmiger formicilis* | *Ruminococcus torques* |
| *Gemmiger formicilis* | *Ruminococcus bromii* | *Ruminococcus obeum* |
| *Gemmiger formicilis* | *Ruminococcus bromii* | *Ruminococcus* sp. 5_1_39BFAA |
| *Gemmiger formicilis* | *Ruminococcus bromii* | *Ruminococcus torques* |
| *Gemmiger formicilis* | *Ruminococcus obeum* | *Ruminococcus* sp. 5_1_39BFAA |
| *Gemmiger formicilis* | *Ruminococcus obeum* | *Ruminococcus torques* |
| *Gemmiger formicilis* | *Ruminococcus* sp. 5_1_39BFAA | *Ruminococcus torques* |

TABLE 16

Augmenting OTUs

| OTU 1 | OTU 2 | OTU 3 | Percent of post-treatment patients in which the ternary is present |
|---|---|---|---|
| Anaerotruncus colihominis | Clostridium orbiscindens | Escherichia coli | 75 |
| Clostridium lactatifermentans | Clostridium orbiscindens | Escherichia coli | 79 |
| Clostridium lactatifermentans | Clostridium orbiscindens | Streptococcus salivarius | 79 |
| Clostridium lactatifermentans | Escherichia coli | Streptococcus salivarius | 75 |
| Clostridium orbiscindens | Clostridium sp. NML 04A032 | Escherichia coli | 89 |
| Clostridium orbiscindens | Clostridium sp. NML 04A032 | Oscillibacter sp. G2 | 89 |
| Clostridium orbiscindens | Clostridium sp. NML 04A032 | Streptococcus salivarius | 93 |
| Clostridium orbiscindens | Escherichia coli | Klebsiella sp. SRC_DSD2 | 75 |
| Clostridium orbiscindens | Escherichia coli | Oscillibacter sp. G2 | 89 |
| Clostridium orbiscindens | Escherichia coli | Streptococcus salivarius | 96 |
| Clostridium orbiscindens | Oscillibacter sp. G2 | Streptococcus salivarius | 89 |
| Clostridium sp. NML 04A032 | Escherichia coli | Oscillibacter sp. G2 | 82 |
| Clostridium sp. NML 04A032 | Escherichia coli | Streptococcus salivarius | 86 |
| Clostridium sp. NML 04A032 | Oscillibacter sp. G2 | Streptococcus salivarius | 86 |
| Escherichia coli | Oscillibacter sp. G2 | Streptococcus salivarius | 82 |

TABLE 17

Ternary OTU combinations in administered spore ecology doses resulting in augmentation or engraftment of the OTU Clostridiales sp. SM4/1

| OTU 1 | OTU 2 | OTU 3 | Percent of doses in which the ternary is present |
|---|---|---|---|
| Clostridium saccharogumia | Eubacterium rectale | Faecalibacterium prausnitzii | 85 |
| Clostridium saccharogumia | Eubacterium rectale | Ruminococcus torques | 85 |
| Clostridium saccharogumia | Faecalibacterium prausnitzii | Ruminococcus torques | 85 |
| Blautia sp. M25 | Clostridium saccharogumia | Eubacterium rectale | 85 |
| Blautia sp. M25 | Clostridium saccharogumia | Faecalibacterium prausnitzii | 85 |
| Blautia sp. M25 | Clostridium saccharogumia | Ruminococcus torques | 85 |
| Clostridium saccharogumia | Eubacterium rectale | Ruminococcus obeum | 85 |
| Clostridium saccharogumia | Eubacterium rectale | Ruminococcus sp. 5_1_39BFAA | 85 |
| Clostridium saccharogumia | Faecalibacterium prausnitzii | Ruminococcus obeum | 85 |
| Clostridium saccharogumia | Faecalibacterium prausnitzii | Ruminococcus sp. 5_1_39BFAA | 85 |
| Clostridium saccharogumia | Ruminococcus obeum | Ruminococcus torques | 85 |
| Clostridium saccharogumia | Ruminococcus sp. 5_1_39BFAA | Ruminococcus torques | 85 |
| Blautia sp. M25 | Clostridium saccharogumia | Ruminococcus sp. 5_1_39BFAA | 85 |
| Blautia sp. M25 | Clostridium saccharogumia | Ruminococcus obeum | 85 |
| Clostridium saccharogumia | Ruminococcus obeum | Ruminococcus sp. 5_1_39BFAA | 85 |
| Clostridium saccharogumia | Faecalibacterium prausnitzii | Ruminococcus bromii | 85 |
| Blautia sp. M25 | Clostridium saccharogumia | Ruminococcus bromii | 85 |
| Clostridium saccharogumia | Eubacterium rectale | Ruminococcus bromii | 85 |
| Clostridium saccharogumia | Ruminococcus bromii | Ruminococcus obeum | 85 |
| Clostridium saccharogumia | Ruminococcus bromii | Ruminococcus sp. 5_1_39BFAA | 85 |
| Clostridium saccharogumia | Ruminococcus bromii | Ruminococcus torques | 85 |
| Clostridiales sp. SSC/2 | Clostridium saccharogumia | Eubacterium rectale | 80 |
| Clostridiales sp. SSC/2 | Clostridium saccharogumia | Faecalibacterium prausnitzii | 80 |
| Clostridiales sp. SSC/2 | Clostridium saccharogumia | Ruminococcus torques | 80 |
| Blautia sp. M25 | Clostridiales sp. SSC/2 | Clostridium saccharogumia | 80 |
| Blautia sp. M25 | Clostridium saccharogumia | Ruminococcus lactaris | 80 |
| Clostridiales sp. SSC/2 | Clostridium saccharogumia | Ruminococcus obeum | 80 |
| Clostridiales sp. SSC/2 | Clostridium saccharogumia | Ruminococcus sp. 5_1_39BFAA | 80 |
| Clostridium lavalense | Clostridium saccharogumia | Eubacterium rectale | 80 |
| Clostridium lavalense | Clostridium saccharogumia | Faecalibacterium prausnitzii | 80 |
| Clostridium lavalense | Clostridium saccharogumia | Ruminococcus torques | 80 |
| Clostridium saccharogumia | Eubacterium rectale | Ruminococcus lactaris | 80 |
| Clostridium saccharogumia | Ruminococcus lactaris | Ruminococcus sp. 5_1_39BFAA | 80 |
| Clostridium saccharogumia | Ruminococcus lactaris | Ruminococcus torques | 80 |
| Blautia sp. M25 | Clostridium lavalense | Clostridium saccharogumia | 80 |
| Clostridium asparagiforme | Clostridium saccharogumia | Eubacterium rectale | 80 |
| Clostridium asparagiforme | Clostridium saccharogumia | Faecalibacterium prausnitzii | 80 |
| Clostridium asparagiforme | Clostridium saccharogumia | Ruminococcus torques | 80 |
| Clostridium lavalense | Clostridium saccharogumia | Ruminococcus obeum | 80 |
| Clostridium lavalense | Clostridium saccharogumia | Ruminococcus sp. 5_1_39BFAA | 80 |
| Clostridium saccharogumia | Eubacterium rectale | Gemmiger formicilis | 80 |
| Clostridium saccharogumia | Faecalibacterium prausnitzii | Ruminococcus lactaris | 80 |

TABLE 17-continued

Ternary OTU combinations in administered spore ecology doses resulting in augmentation or engraftment of the OTU Clostridiales sp. SM4/1

| OTU 1 | OTU 2 | OTU 3 | Percent of doses in which the ternary is present |
|---|---|---|---|
| Clostridium saccharogumia | Gemmiger formicilis | Ruminococcus torques | 80 |
| Clostridium saccharogumia | Ruminococcus lactaris | Ruminococcus obeum | 80 |
| Clostridium saccharogumia | Faecalibacterium prausnitzii | Gemmiger formicilis | 80 |
| Blautia sp. M25 | Clostridium asparagiforme | Clostridium saccharogumia | 80 |
| Blautia sp. M25 | Clostridium saccharogumia | Gemmiger formicilis | 80 |
| Clostridium asparagiforme | Clostridium saccharogumia | Ruminococcus obeum | 80 |
| Clostridium asparagiforme | Clostridium saccharogumia | Ruminococcus sp. 5_1_39BFAA | 80 |
| Clostridium saccharogumia | Coprococcus comes | Eubacterium rectale | 80 |
| Clostridium saccharogumia | Coprococcus comes | Faecalibacterium prausnitzii | 80 |
| Clostridium saccharogumia | Coprococcus comes | Ruminococcus obeum | 80 |
| Clostridium saccharogumia | Coprococcus comes | Ruminococcus torques | 80 |
| Clostridium saccharogumia | Dorea formicigenerans | Eubacterium rectale | 80 |
| Clostridium saccharogumia | Dorea formicigenerans | Faecalibacterium prausnitzii | 80 |
| Clostridium saccharogumia | Dorea formicigenerans | Ruminococcus obeum | 80 |
| Clostridium saccharogumia | Dorea formicigenerans | Ruminococcus torques | 80 |
| Clostridium saccharogumia | Gemmiger formicilis | Ruminococcus obeum | 80 |
| Clostridium saccharogumia | Gemmiger formicilis | Ruminococcus sp. 5_1_39BFAA | 80 |
| Clostridium asparagiforme | Clostridium lavalense | Clostridium saccharogumia | 80 |
| Blautia sp. M25 | Clostridium saccharogumia | Coprococcus comes | 80 |
| Blautia sp. M25 | Clostridium saccharogumia | Dorea formicigenerans | 80 |
| Blautia sp. M25 | Clostridium saccharogumia | Eubacterium hallii | 80 |
| Clostridiales sp. SSC/2 | Clostridium saccharogumia | Ruminococcus bromii | 80 |
| Clostridium asparagiforme | Clostridium saccharogumia | Ruminococcus bromii | 80 |
| Clostridium asparagiforme | Clostridium saccharogumia | Ruminococcus lactaris | 80 |
| Clostridium lavalense | Clostridium saccharogumia | Dorea formicigenerans | 80 |
| Clostridium lavalense | Clostridium saccharogumia | Ruminococcus bromii | 80 |
| Clostridium lavalense | Clostridium saccharogumia | Ruminococcus lactaris | 80 |
| Clostridium saccharogumia | Coprococcus comes | Ruminococcus sp. 5_1_39BFAA | 80 |
| Clostridium saccharogumia | Dorea formicigenerans | Ruminococcus lactaris | 80 |
| Clostridium saccharogumia | Dorea formicigenerans | Ruminococcus sp. 5_1_39BFAA | 80 |
| Clostridium saccharogumia | Eubacterium hallii | Eubacterium rectale | 80 |
| Clostridium saccharogumia | Eubacterium hallii | Faecalibacterium prausnitzii | 80 |
| Clostridium saccharogumia | Eubacterium hallii | Ruminococcus lactaris | 80 |
| Clostridium saccharogumia | Eubacterium hallii | Ruminococcus obeum | 80 |
| Clostridium saccharogumia | Eubacterium hallii | Ruminococcus sp. 5_1_39BFAA | 80 |
| Clostridium saccharogumia | Eubacterium hallii | Ruminococcus torques | 80 |
| Clostridium saccharogumia | Ruminococcus bromii | Ruminococcus lactaris | 80 |
| Clostridium asparagiforme | Clostridium saccharogumia | Coprococcus comes | 80 |
| Clostridium asparagiforme | Clostridium saccharogumia | Eubacterium hallii | 80 |
| Clostridium lavalense | Clostridium saccharogumia | Coprococcus comes | 80 |
| Clostridium saccharogumia | Coprococcus comes | Ruminococcus bromii | 80 |
| Clostridium saccharogumia | Coprococcus comes | Ruminococcus lactaris | 80 |
| Clostridium saccharogumia | Gemmiger formicilis | Ruminococcus bromii | 80 |
| Blautia sp. M25 | Clostridium saccharogumia | Coprococcus catus | 80 |
| Blautia sp. M25 | Clostridium saccharogumia | Dorea longicatena | 80 |
| Clostridium asparagiforme | Clostridium saccharogumia | Dorea formicigenerans | 80 |
| Clostridium asparagiforme | Clostridium saccharogumia | Dorea longicatena | 80 |
| Clostridium lavalense | Clostridium saccharogumia | Dorea longicatena | 80 |
| Clostridium lavalense | Clostridium saccharogumia | Eubacterium hallii | 80 |
| Clostridium saccharogumia | Coprococcus catus | Eubacterium rectale | 80 |
| Clostridium saccharogumia | Coprococcus catus | Faecalibacterium prausnitzii | 80 |
| Clostridium saccharogumia | Coprococcus catus | Ruminococcus sp. 5_1_39BFAA | 80 |
| Clostridium saccharogumia | Coprococcus catus | Ruminococcus torques | 80 |
| Clostridium saccharogumia | Coprococcus comes | Dorea formicigenerans | 80 |
| Clostridium saccharogumia | Coprococcus comes | Eubacterium hallii | 80 |
| Clostridium saccharogumia | Dorea formicigenerans | Eubacterium hallii | 80 |
| Clostridium saccharogumia | Dorea formicigenerans | Ruminococcus bromii | 80 |
| Clostridium saccharogumia | Dorea longicatena | Eubacterium rectale | 80 |
| Clostridium saccharogumia | Dorea longicatena | Faecalibacterium prausnitzii | 80 |
| Clostridium saccharogumia | Dorea longicatena | Ruminococcus obeum | 80 |
| Clostridium saccharogumia | Dorea longicatena | Ruminococcus sp. 5_1_39BFAA | 80 |
| Clostridium saccharogumia | Dorea longicatena | Ruminococcus torques | 80 |
| Clostridium saccharogumia | Eubacterium hallii | Ruminococcus bromii | 80 |
| Clostridiales sp. SSC/2 | Clostridium saccharogumia | Coprococcus catus | 80 |
| Clostridium saccharogumia | Coprococcus catus | Ruminococcus obeum | 80 |
| Clostridium saccharogumia | Dorea longicatena | Eubacterium hallii | 80 |

TABLE 17-continued

Ternary OTU combinations in administered spore ecology doses resulting in augmentation or engraftment of the OTU Clostridiales sp. SM4/1

| OTU 1 | OTU 2 | OTU 3 | Percent of doses in which the ternary is present |
|---|---|---|---|
| Clostridium saccharogumia | Dorea longicatena | Ruminococcus bromii | 80 |
| Clostridium saccharogumia | Dorea longicatena | Ruminococcus lactaris | 80 |
| Clostridium saccharogumia | Dorea formicigenerans | Dorea longicatena | 80 |
| Clostridium saccharogumia | Coprococcus catus | Ruminococcus bromii | 80 |
| Clostridium saccharogumia | Coprococcus comes | Dorea longicatena | 80 |
| Blautia sp. M25 | Clostridium algidixylanolyticum | Faecalibacterium prausnitzii | 75 |
| Clostridium algidixylanolyticum | Faecalibacterium prausnitzii | Ruminococcus obeum | 75 |
| Clostridium algidixylanolyticum | Faecalibacterium prausnitzii | Ruminococcus torques | 75 |
| Blautia sp. M25 | Clostridium algidixylanolyticum | Ruminococcus obeum | 75 |
| Blautia sp. M25 | Clostridium algidixylanolyticum | Ruminococcus torques | 75 |
| Clostridium algidixylanolyticum | Faecalibacterium prausnitzii | Ruminococcus sp. 5_1_39BFAA | 75 |
| Clostridium algidixylanolyticum | Ruminococcus obeum | Ruminococcus torques | 75 |
| Blautia sp. M25 | Clostridium algidixylanolyticum | Ruminococcus sp. 5_1_39BFAA | 75 |
| Clostridium algidixylanolyticum | Ruminococcus sp. 5_1_39BFAA | Ruminococcus torques | 75 |
| Clostridium algidixylanolyticum | Ruminococcus obeum | Ruminococcus sp. 5_1_39BFAA | 75 |
| Clostridiales sp. SSC/2 | Clostridium. algidixylanolyticum | Ruminococcus torques | 75 |
| Clostridiales sp. SSC/2 | Clostridium. algidixylanolyticum | Faecalibacterium prausnitzii | 75 |
| Clostridiales sp. SSC/2 | Clostridium. algidixylanolyticum | Ruminococcus obeum | 75 |
| Clostridiales sp. SSC/2 | Clostridium algidixylanolyticum | Ruminococcus sp. 5_1_39BFAA | 75 |
| Clostridium algidixylanolyticum | Ruminococcus bromii | Ruminococcus torques | 75 |
| Blautia sp. M25 | Clostridiales sp. SSC/2 | Clostridium algidixylanolyticum | 75 |
| Blautia sp. M25 | Clostridium algidixylanolyticum | Ruminococcus bromii | 75 |
| Clostridium algidixylanolyticum | Faecalibacterium prausnitzii | Ruminococcus bromii | 75 |
| Clostridium algidixylanolyticum | Ruminococcus bromii | Ruminococcus obeum | 75 |
| Clostridium algidixylanolyticum | Ruminococcus bromii | Ruminococcus sp. 5_1_39BFAA | 75 |
| Clostridiales sp. SSC/2 | Clostridium algidixylanolyticum | Ruminococcus bromii | 75 |
| Clostridium algidixylanolyticum | Coprococcus catus | Faecalibacterium prausnitzii | 75 |
| Clostridium algidixylanolyticum | Coprococcus catus | Ruminococcus sp. 5_1_39BFAA | 75 |
| Blautia sp. M25 | Clostridium algidixylanolyticum | Coprococcus catus | 75 |
| Clostridium algidixylanolyticum | Coprococcus catus | Ruminococcus obeum | 75 |
| Clostridium algidixylanolyticum | Coprococcus catus | Ruminococcus torques | 75 |
| Clostridiales sp. SSC/2 | Clostridium saccharogumia | Ruminococcus lactaris | 75 |
| Clostridiales sp. SSC/2 | Clostridium algidixylanolyticum | Coprococcus catus | 75 |
| Clostridiales sp. SSC/2 | Clostridium saccharogumia | Gemmiger formicilis | 75 |
| Clostridiales sp. SSC/2 | Clostridium lavalense | Clostridium saccharogumia | 75 |
| Clostridiales sp. SSC/2 | Clostridium saccharogumia | Dorea formicigenerans | 75 |
| Clostridium algidixylanolyticum | Coprococcus catus | Ruminococcus bromii | 75 |
| Clostridium lavalense | Clostridium saccharogumia | Gemmiger formicilis | 75 |
| Clostridium saccharogumia | Gemmiger formicilis | Ruminococcus lactaris | 75 |
| Clostridiales sp. SSC/2 | Clostridium asparagiforme | Clostridium saccharogumia | 75 |
| Clostridiales sp. SSC/2 | Clostridium saccharogumia | Coprococcus comes | 75 |
| Clostridiales sp. SSC/2 | Clostridium saccharogumia | Eubacterium hallii | 75 |
| Clostridium saccharogumia | Dorea formicigenerans | Gemmiger formicilis | 75 |
| Clostridium asparagiforme | Clostridium saccharogumia | Gemmiger formicilis | 75 |
| Clostridium saccharogumia | Coprococcus comes | Gemmiger formicilis | 75 |
| Clostridium asparagiforme | Clostridium saccharogumia | Coprococcus catus | 75 |
| Clostridium lavalense | Clostridium saccharogumia | Coprococcus catus | 75 |
| Clostridium saccharogumia | Eubacterium hallii | Gemmiger formicilis | 75 |
| Blautia sp. M25 | Clostridium saccharogumia | Eubacterium ramulus | 75 |
| Clostridiales sp. SSC/2 | Clostridium saccharogumia | Dorea longicatena | 75 |
| Clostridiales sp. SSC/2 | Clostridium saccharogumia | Eubacterium ramulus | 75 |
| Clostridium saccharogumia | Coprococcus catus | Ruminococcus lactaris | 75 |
| Clostridium saccharogumia | Eubacterium ramulus | Eubacterium rectale | 75 |
| Clostridium saccharogumia | Eubacterium ramulus | Faecalibacterium prausnitzii | 75 |
| Clostridium saccharogumia | Eubacterium ramulus | Ruminococcus obeum | 75 |
| Clostridium saccharogumia | Eubacterium ramulus | Ruminococcus sp. 5_1_39BFAA | 75 |
| Clostridium saccharogumia | Eubacterium ramulus | Ruminococcus torques | 75 |
| Clostridium asparagiforme | Clostridium saccharogumia | Eubacterium ramulus | 75 |
| Clostridium saccharogumia | Coprococcus catus | Dorea longicatena | 75 |
| Clostridium saccharogumia | Coprococcus catus | Eubacterium hallii | 75 |
| Clostridium saccharogumia | Coprococcus catus | Gemmiger formicilis | 75 |
| Clostridium saccharogumia | Coprococcus comes | Eubacterium ramulus | 75 |
| Clostridium saccharogumia | Dorea longicatena | Gemmiger formicilis | 75 |
| Clostridium saccharogumia | Eubacterium hallii | Eubacterium ramulus | 75 |
| Clostridium saccharogumia | Eubacterium ramulus | Ruminococcus lactaris | 75 |
| Clostridium lavalense | Clostridium saccharogumia | Eubacterium ramulus | 75 |

TABLE 17-continued

Ternary OTU combinations in administered spore ecology doses resulting in augmentation or engraftment of the OTU Clostridiales sp. SM4/1

| OTU 1 | OTU 2 | OTU 3 | Percent of doses in which the ternary is present |
|---|---|---|---|
| Clostridium saccharogumia | Coprococcus catus | Coprococcus comes | 75 |
| Clostridium saccharogumia | Coprococcus catus | Dorea formicigenerans | 75 |
| Clostridium saccharogumia | Dorea formicigenerans | Eubacterium ramulus | 75 |
| Clostridium saccharogumia | Eubacterium ramulus | Ruminococcus bromii | 75 |
| Clostridium saccharogumia | Coprococcus catus | Eubacterium ramulus | 75 |
| Clostridium saccharogumia | Dorea longicatena | Eubacterium ramulus | 75 |

TABLE 18

Ternary OTU combinations in administered spore ecology doses that result in augmentation or engraftment of the OTU Clostridiales sp. SSC/2.

| OTU 1 | OTU 2 | OTU 3 | Percent of doses in which the ternary is present |
|---|---|---|---|
| Faecalibacterium prausnitzii | Ruminococcus obeum | Turicibacter sanguinis | 85 |
| Faecalibacterium prausnitzii | Ruminococcus torques | Turicibacter sanguinis | 85 |
| Blautia sp. M25 | Faecalibacterium prausnitzii | Turicibacter sanguinis | 85 |
| Blautia sp. M25 | Ruminococcus torques | Turicibacter sanguinis | 85 |
| Faecalibacterium prausnitzii | Ruminococcus sp. 5_1_39BFAA | Turicibacter sanguinis | 85 |
| Ruminococcus obeum | Ruminococcus torques | Turicibacter sanguinis | 85 |
| Ruminococcus obeum | Ruminococcus sp. 5_1_39BFAA | Turicibacter sanguinis | 85 |
| Ruminococcus sp. 5_1_39BFAA | Ruminococcus torques | Turicibacter sanguinis | 85 |
| Blautia sp. M25 | Ruminococcus obeum | Turicibacter sanguinis | 85 |
| Faecalibacterium prausnitzii | Ruminococcus bromii | Turicibacter sanguinis | 85 |
| Ruminococcus bromii | Ruminococcus obeum | Turicibacter sanguinis | 85 |
| Ruminococcus bromii | Ruminococcus torques | Turicibacter sanguinis | 85 |
| Blautia sp. M25 | Ruminococcus sp. 5_1_39BFAA | Turicibacter sanguinis | 85 |
| Ruminococcus bromii | Ruminococcus sp. 5_1_39BFAA | Turicibacter sanguinis | 85 |
| Blautia sp. M25 | Ruminococcus bromii | Turicibacter sanguinis | 85 |
| Clostridiales sp. SSC/2 | Faecalibacterium prausnitzii | Turicibacter sanguinis | 80 |
| Clostridiales sp. SSC/2 | Ruminococcus obeum | Turicibacter sanguinis | 80 |
| Clostridiales sp. SSC/2 | Ruminococcus sp. 5_1_39BFAA | Turicibacter sanguinis | 80 |
| Clostridiales sp. SSC/2 | Ruminococcus torques | Turicibacter sanguinis | 80 |
| Blautia sp. M25 | Clostridiales sp. SSC/2 | Turicibacter sanguinis | 80 |
| Blautia sp. M25 | Gemmiger formicilis | Turicibacter sanguinis | 80 |
| Gemmiger formicilis | Ruminococcus obeum | Turicibacter sanguinis | 80 |
| Gemmiger formicilis | Ruminococcus sp. 5_1_39BFAA | Turicibacter sanguinis | 80 |
| Gemmiger formicilis | Ruminococcus torques | Turicibacter sanguinis | 80 |
| Faecalibacterium prausnitzii | Gemmiger formicilis | Turicibacter sanguinis | 80 |
| Clostridiales sp. SSC/2 | Ruminococcus bromii | Turicibacter sanguinis | 80 |
| Eubacterium hallii | Faecalibacterium prausnitzii | Turicibacter sanguinis | 80 |
| Eubacterium hallii | Ruminococcus obeum | Turicibacter sanguinis | 80 |
| Eubacterium hallii | Ruminococcus sp. 5_1_39BFAA | Turicibacter sanguinis | 80 |
| Eubacterium hallii | Ruminococcus torques | Turicibacter sanguinis | 80 |
| Gemmiger formicilis | Ruminococcus bromii | Turicibacter sanguinis | 80 |
| Blautia sp. M25 | Eubacterium hallii | Turicibacter sanguinis | 80 |
| Eubacterium hallii | Ruminococcus bromii | Turicibacter sanguinis | 80 |
| Blautia sp. M25 | Coprococcus catus | Turicibacter sanguinis | 80 |
| Coprococcus catus | Faecalibacterium prausnitzii | Turicibacter sanguinis | 80 |
| Coprococcus catus | Ruminococcus obeum | Turicibacter sanguinis | 80 |
| Coprococcus catus | Ruminococcus sp. 5_1_39BFAA | Turicibacter sanguinis | 80 |
| Coprococcus catus | Ruminococcus torques | Turicibacter sanguinis | 80 |
| Clostridiales sp. SSC/2 | Coprococcus catus | Turicibacter sanguinis | 80 |
| Coprococcus catus | Ruminococcus bromii | Turicibacter sanguinis | 80 |
| Clostridium bartlettii | Faecalibacterium prausnitzii | Ruminococcus obeum | 75 |
| Clostridium bartlettii | Faecalibacterium prausnitzii | Ruminococcus torques | 75 |
| Blautia sp. M25 | Clostridium bartlettii | Faecalibacterium prausnitzii | 75 |
| Clostridium bartlettii | Ruminococcus obeum | Ruminococcus torques | 75 |
| Clostridium bartlettii | Ruminococcus sp. 5_1_39BFAA | Ruminococcus torques | 75 |
| Blautia sp. M25 | Clostridium bartlettii | Ruminococcus torques | 75 |
| Clostridium bartlettii | Faecalibacterium prausnitzii | Ruminococcus sp. 5_1_39BFAA | 75 |
| Blautia sp. M25 | Clostridium bartlettii | Ruminococcus obeum | 75 |

TABLE 18-continued

Ternary OTU combinations in administered spore ecology doses that result in augmentation or engraftment of the OTU Clostridiales sp. SSC/2.

| OTU 1 | OTU 2 | OTU 3 | Percent of doses in which the ternary is present |
|---|---|---|---|
| Clostridium bartlettii | Ruminococcus obeum | Ruminococcus sp. 5_1_39BFAA | 75 |
| Blautia sp. M25 | Clostridium bartlettii | Ruminococcus sp. 5_1_39BFAA | 75 |
| Clostridium bartlettii | Ruminococcus bromii | Ruminococcus torques | 75 |
| Clostridium bartlettii | Faecalibacterium prausnitzii | Ruminococcus bromii | 75 |
| Clostridium bartlettii | Ruminococcus bromii | Ruminococcus obeum | 75 |
| Blautia sp. M25 | Clostridium bartlettii | Ruminococcus bromii | 75 |
| Clostridium bartlettii | Ruminococcus bromii | Ruminococcus sp. 5_1_39BFAA | 75 |
| Eubacterium rectale | Faecalibacterium prausnitzii | Turicibacter sanguinis | 75 |
| Eubacterium rectale | Ruminococcus obeum | Turicibacter sanguinis | 75 |
| Eubacterium rectale | Ruminococcus sp. 5_1_39BFAA | Turicibacter sanguinis | 75 |
| Eubacterium rectale | Ruminococcus torques | Turicibacter sanguinis | 75 |
| Blautia sp. M25 | Eubacterium rectale | Turicibacter sanguinis | 75 |
| Clostridium asparagiforme | Faecalibacterium prausnitzii | Turicibacter sanguinis | 75 |
| Clostridium asparagiforme | Ruminococcus obeum | Turicibacter sanguinis | 75 |
| Clostridium asparagiforme | Ruminococcus sp. 5_1_39BFAA | Turicibacter sanguinis | 75 |
| Eubacterium rectale | Ruminococcus bromii | Turicibacter sanguinis | 75 |
| Clostridium asparagiforme | Ruminococcus torques | Turicibacter sanguinis | 75 |
| Blautia sp. M25 | Clostridium asparagiforme | Turicibacter sanguinis | 75 |
| Clostridiales sp. SSC/2 | Eubacterium hallii | Turicibacter sanguinis | 75 |
| Clostridiales sp. SSC/2 | Gemmiger formicilis | Turicibacter sanguinis | 75 |
| Clostridium asparagiforme | Ruminococcus bromii | Turicibacter sanguinis | 75 |
| Clostridium sp. SS2/1 | Ruminococcus torques | Turicibacter sanguinis | 75 |
| Clostridium asparagiforme | Eubacterium hallii | Turicibacter sanguinis | 75 |
| Clostridium sp. SS2/1 | Faecalibacterium prausnitzii | Turicibacter sanguinis | 75 |
| Clostridium sp. SS2/1 | Ruminococcus obeum | Turicibacter sanguinis | 75 |
| Clostridium sp. SS2/1 | Ruminococcus sp. 5_1_39BFAA | Turicibacter sanguinis | 75 |
| Eubacterium hallii | Gemmiger formicilis | Turicibacter sanguinis | 75 |
| Clostridiales sp. SSC/2 | Clostridium sp. SS2/1 | Turicibacter sanguinis | 75 |
| Blautia sp. M25 | Clostridium sp. SS2/1 | Turicibacter sanguinis | 75 |
| Clostridium sp. SS2/1 | Ruminococcus bromii | Turicibacter sanguinis | 75 |
| Clostridium sp. SS2/1 | Coprococcus catus | Turicibacter sanguinis | 75 |
| Collinsella aerofaciens | Faecalibacterium prausnitzii | Turicibacter sanguinis | 75 |
| Collinsella aerofaciens | Ruminococcus bromii | Turicibacter sanguinis | 75 |
| Collinsella aerofaciens | Ruminococcus obeum | Turicibacter sanguinis | 75 |
| Collinsella aerofaciens | Ruminococcus torques | Turicibacter sanguinis | 75 |
| Coprococcus catus | Eubacterium hallii | Turicibacter sanguinis | 75 |
| Coprococcus catus | Gemmiger formicilis | Turicibacter sanguinis | 75 |
| Blautia sp. M25 | Collinsella aerofaciens | Turicibacter sanguinis | 75 |
| Collinsella aerofaciens | Eubacterium hallii | Turicibacter sanguinis | 75 |
| Collinsella aerofaciens | Ruminococcus sp. 5_1_39BFAA | Turicibacter sanguinis | 75 |

TABLE 19

Ternary OTU combinations in administered spore ecology doses that result in augmentation or engraftment of the OTU Clostridium sp. NML 04A032.

| OTU 1 | OTU 2 | OTU 3 | Percent of doses in which the ternary is present |
|---|---|---|---|
| Clostridium asparagiforme | Faecalibacterium prausnitzii | Ruminococcus champanellensis | 80 |
| Clostridium asparagiforme | Ruminococcus champanellensis | Ruminococcus torques | 80 |
| Clostridium asparagiforme | Ruminococcus champanellensis | Ruminococcus obeum | 80 |
| Blautia sp. M25 | Clostridium asparagiforme | Ruminococcus champanellensis | 80 |
| Clostridium asparagiforme | Ruminococcus champanellensis | Ruminococcus sp. 5_1_39BFAA | 80 |
| Clostridium asparagiforme | Ruminococcus bromii | Ruminococcus champanellensis | 80 |
| Clostridium asparagiforme | Eubacterium hallii | Ruminococcus champanellensis | 80 |
| Clostridiales bacterium 1_7_47FAA | Eubacterium rectale | Faecalibacterium prausnitzii | 75 |
| Clostridiales bacterium 1_7_47FAA | Eubacterium rectale | Ruminococcus obeum | 75 |
| Clostridiales bacterium 1_7_47FAA | Eubacterium rectale | Ruminococcus torques | 75 |
| Blautia sp. M25 | Clostridiales bacterium 1_7_47FAA | Eubacterium rectale | 75 |
| Clostridiales bacterium 1_7_47FAA | Eubacterium rectale | Ruminococcus sp. 5_1_39BFAA | 75 |
| Eubacterium rectale | Faecalibacterium prausnitzii | Ruminococcus champanellensis | 75 |
| Faecalibacterium prausnitzii | Ruminococcus champanellensis | Ruminococcus lactaris | 75 |
| Clostridiales bacterium 1_7_47FAA | Clostridium asparagiforme | Faecalibacterium prausnitzii | 75 |

TABLE 19-continued

Ternary OTU combinations in administered spore ecology doses that result in augmentation or engraftment of the OTU Clostridium sp. NML 04A032.

| OTU 1 | OTU 2 | OTU 3 | Percent of doses in which the ternary is present |
|---|---|---|---|
| Clostridiales bacterium 1_7_47FAA | Clostridium asparagiforme | Ruminococcus torques | 75 |
| Blautia sp. M25 | Ruminococcus champanellensis | Ruminococcus lactaris | 75 |
| Eubacterium rectale | Ruminococcus champanellensis | Ruminococcus obeum | 75 |
| Eubacterium rectale | Ruminococcus champanellensis | Ruminococcus torques | 75 |
| Ruminococcus champanellensis | Ruminococcus lactaris | Ruminococcus obeum | 75 |
| Clostridiales bacterium 1_7_47FAA | Clostridium asparagiforme | Ruminococcus obeum | 75 |
| Ruminococcus champanellensis | Ruminococcus lactaris | Ruminococcus torques | 75 |
| Blautia sp. M25 | Eubacterium rectale | Ruminococcus champanellensis | 75 |
| Clostridium lavalense | Faecalibacterium prausnitzii | Ruminococcus champanellensis | 75 |
| Eubacterium rectale | Ruminococcus champanellensis | Ruminococcus lactaris | 75 |
| Clostridiales bacterium 1_7_47FAA | Clostridium asparagiforme | Ruminococcus sp. 5_1_39BFAA | 75 |
| Clostridiales bacterium 1_7_47FAA | Eubacterium rectale | Ruminococcus bromii | 75 |
| Clostridium lavalense | Ruminococcus champanellensis | Ruminococcus obeum | 75 |
| Clostridium lavalense | Ruminococcus champanellensis | Ruminococcus torques | 75 |
| Eubacterium rectale | Ruminococcus champanellensis | Ruminococcus sp. 5_1_39BFAA | 75 |
| Ruminococcus bromii | Ruminococcus champanellensis | Ruminococcus lactaris | 75 |
| Ruminococcus champanellensis | Ruminococcus lactaris | Ruminococcus sp. 5_1_39BFAA | 75 |
| Blautia sp. M25 | Clostridiales bacterium 1_7_47FAA | Clostridium asparagiforme | 75 |
| Clostridium lavalense | Eubacterium rectale | Ruminococcus champanellensis | 75 |
| Clostridium lavalense | Ruminococcus champanellensis | Ruminococcus lactaris | 75 |
| Clostridium lavalense | Ruminococcus champanellensis | Ruminococcus sp. 5_1_39BFAA | 75 |
| Blautia sp. M25 | Clostridium lavalense | Ruminococcus champanellensis | 75 |
| Clostridium asparagiforme | Eubacterium rectale | Ruminococcus champanellensis | 75 |
| Clostridium lavalense | Ruminococcus bromii | Ruminococcus champanellensis | 75 |
| Eubacterium rectale | Ruminococcus bromii | Ruminococcus champanellensis | 75 |
| Clostridiales bacterium 1_7_47FAA | Clostridium asparagiforme | Ruminococcus bromii | 75 |
| Clostridium asparagiforme | Ruminococcus champanellensis | Ruminococcus lactaris | 75 |
| Clostridiales bacterium 1_7_47FAA | Clostridium asparagiforme | Eubacterium hallii | 75 |
| Clostridium asparagiforme | Clostridium lavalense | Ruminococcus champanellensis | 75 |
| Coprococcus comes | Eubacterium rectale | Ruminococcus champanellensis | 75 |
| Coprococcus comes | Faecalibacterium prausnitzii | Ruminococcus champanellensis | 75 |
| Coprococcus comes | Ruminococcus champanellensis | Ruminococcus obeum | 75 |
| Coprococcus comes | Ruminococcus champanellensis | Ruminococcus torques | 75 |
| Dorea formicigenerans | Eubacterium rectale | Ruminococcus champanellensis | 75 |
| Dorea formicigenerans | Faecalibacterium prausnitzii | Ruminococcus champanellensis | 75 |
| Dorea formicigenerans | Ruminococcus champanellensis | Ruminococcus obeum | 75 |
| Dorea formicigenerans | Ruminococcus champanellensis | Ruminococcus torques | 75 |
| Dorea longicatena | Ruminococcus champanellensis | Ruminococcus obeum | 75 |
| Blautia sp. M25 | Coprococcus comes | Ruminococcus champanellensis | 75 |
| Blautia sp. M25 | Dorea longicatena | Ruminococcus champanellensis | 75 |
| Dorea formicigenerans | Ruminococcus champanellensis | Ruminococcus lactaris | 75 |
| Dorea longicatena | Faecalibacterium prausnitzii | Ruminococcus champanellensis | 75 |
| Dorea longicatena | Ruminococcus champanellensis | Ruminococcus torques | 75 |
| Eubacterium hallii | Eubacterium rectale | Ruminococcus champanellensis | 75 |
| Eubacterium hallii | Ruminococcus champanellensis | Ruminococcus lactaris | 75 |
| Blautia sp. M25 | Dorea formicigenerans | Ruminococcus champanellensis | 75 |
| Clostridium asparagiforme | Dorea longicatena | Ruminococcus champanellensis | 75 |
| Clostridium asparagiforme | Gemmiger formicilis | Ruminococcus champanellensis | 75 |
| Clostridium lavalense | Dorea formicigenerans | Ruminococcus champanellensis | 75 |
| Dorea formicigenerans | Ruminococcus champanellensis | Ruminococcus sp. 5_1_39BFAA | 75 |
| Dorea longicatena | Eubacterium rectale | Ruminococcus champanellensis | 75 |
| Dorea longicatena | Ruminococcus champanellensis | Ruminococcus lactaris | 75 |
| Clostridiales sp. SSC/2 | Clostridium asparagiforme | Ruminococcus champanellensis | 75 |
| Clostridium asparagiforme | Coprococcus comes | Ruminococcus champanellensis | 75 |
| Clostridium asparagiforme | Dorea formicigenerans | Ruminococcus champanellensis | 75 |
| Clostridium lavalense | Dorea longicatena | Ruminococcus champanellensis | 75 |
| Coprococcus comes | Ruminococcus bromii | Ruminococcus champanellensis | 75 |
| Coprococcus comes | Ruminococcus champanellensis | Ruminococcus lactaris | 75 |
| Coprococcus comes | Ruminococcus champanellensis | Ruminococcus sp. 5_1_39BFAA | 75 |
| Dorea longicatena | Ruminococcus bromii | Ruminococcus champanellensis | 75 |
| Dorea longicatena | Ruminococcus champanellensis | Ruminococcus sp. 5_1_39BFAA | 75 |
| Clostridium asparagiforme | Coprococcus catus | Ruminococcus champanellensis | 75 |
| Clostridium lavalense | Eubacterium hallii | Ruminococcus champanellensis | 75 |

TABLE 19-continued

Ternary OTU combinations in administered spore ecology doses that result in augmentation or engraftment of the OTU *Clostridium* sp. NML 04A032.

| OTU 1 | OTU 2 | OTU 3 | Percent of doses in which the ternary is present |
|---|---|---|---|
| *Dorea formicigenerans* | *Eubacterium hallii* | *Ruminococcus champanellensis* | 75 |
| *Dorea formicigenerans* | *Dorea longicatena* | *Ruminococcus champanellensis* | 75 |
| *Clostridium lavalense* | *Coprococcus comes* | *Ruminococcus champanellensis* | 75 |
| *Coprococcus comes* | *Dorea formicigenerans* | *Ruminococcus champanellensis* | 75 |
| *Coprococcus comes* | *Eubacterium hallii* | *Ruminococcus champanellensis* | 75 |
| *Dorea formicigenerans* | *Ruminococcus bromii* | *Ruminococcus champanellensis* | 75 |
| *Coprococcus comes* | *Dorea longicatena* | *Ruminococcus champanellensis* | 75 |
| *Dorea longicatena* | *Eubacterium hallii* | *Ruminococcus champanellensis* | 75 |
| *Clostridium asparagiforme* | *Collinsella aerofaciens* | *Ruminococcus champanellensis* | 75 |

TABLE 20

Ternary OTU combinations in administered spore ecology doses that result in augmentation or engraftment of the OTUs *Clostridium* sp. NML 04A032, *Ruminococcus lactaris*, and *Ruminococcus torques*.

| OTU 1 | OTU 2 | OTU 3 | Percent of doses in which the ternary is present |
|---|---|---|---|
| Clostridiales sp. SM4/1 | *Faecalibacterium prausnitzii* | *Ruminococcus obeum* | 75 |
| Clostridiales sp. SM4/1 | *Faecalibacterium prausnitzii* | *Ruminococcus torques* | 75 |
| Clostridiales sp. SM4/1 | *Ruminococcus obeum* | *Ruminococcus torques* | 75 |
| *Blautia* sp. M25 | Clostridiales sp. SM4/1 | *Faecalibacterium prausnitzii* | 75 |
| Clostridiales sp. SM4/1 | *Ruminococcus* sp. 5_1_39BFAA | *Ruminococcus torques* | 75 |
| *Blautia* sp. M25 | Clostridiales sp. SM4/1 | *Ruminococcus torques* | 75 |
| Clostridiales sp. SM4/1 | *Faecalibacterium prausnitzii* | *Ruminococcus* sp. 5_1_39BFAA | 75 |
| *Blautia* sp. M25 | Clostridiales sp. SM4/1 | *Ruminococcus obeum* | 75 |
| *Blautia* sp. M25 | Clostridiales sp. SM4/1 | *Ruminococcus* sp. 5_1_39BFAA | 75 |
| Clostridiales sp. SM4/1 | *Ruminococcus obeum* | *Ruminococcus* sp. 5_1_39BFAA | 75 |
| Clostridiales sp. SM4/1 | *Clostridium asparagiforme* | *Faecalibacterium prausnitzii* | 75 |
| Clostridiales sp. SM4/1 | *Clostridium asparagiforme* | *Ruminococcus torques* | 75 |
| Clostridiales sp. SM4/1 | *Clostridium asparagiforme* | *Ruminococcus obeum* | 75 |
| *Blautia* sp. M25 | Clostridiales sp. SM4/1 | *Ruminococcus bromii* | 75 |
| Clostridiales sp. SM4/1 | *Faecalibacterium prausnitzii* | *Ruminococcus bromii* | 75 |
| Clostridiales sp. SM4/1 | *Ruminococcus bromii* | *Ruminococcus obeum* | 75 |
| Clostridiales sp. SM4/1 | *Ruminococcus bromii* | *Ruminococcus* sp. 5_1_39BFAA | 75 |
| Clostridiales sp. SM4/1 | *Ruminococcus bromii* | *Ruminococcus torques* | 75 |
| *Blautia* sp. M25 | Clostridiales sp. SM4/1 | *Clostridium asparagiforme* | 75 |
| Clostridiales sp. SM4/1 | *Clostridium asparagiforme* | *Ruminococcus* sp. 5_1_39BFAA | 75 |
| Clostridiales sp. SM4/1 | *Eubacterium hallii* | *Faecalibacterium prausnitzii* | 75 |
| Clostridiales sp. SM4/1 | *Eubacterium hallii* | *Ruminococcus obeum* | 75 |
| Clostridiales sp. SM4/1 | *Eubacterium hallii* | *Ruminococcus torques* | 75 |
| *Blautia* sp. M25 | Clostridiales sp. SM4/1 | *Eubacterium hallii* | 75 |
| Clostridiales sp. SM4/1 | *Eubacterium hallii* | *Ruminococcus* sp. 5_1_39BFAA | 75 |
| Clostridiales sp. SM4/1 | *Clostridium asparagiforme* | *Ruminococcus bromii* | 75 |
| Clostridiales sp. SM4/1 | *Clostridium asparagiforme* | *Eubacterium hallii* | 75 |
| Clostridiales sp. SM4/1 | *Eubacterium hallii* | *Ruminococcus bromii* | 75 |

TABLE 21

Ternary OTU combinations in administered spore ecology doses that result in augmentation or engraftment of the OTUs *Eubacterium rectale, Faecalibacterium prausnitzii, Oscillibacter* sp. G2, *Ruminococcus lactaris*, and *Ruminococcus torques*.

| OTU 1 | OTU 2 | OTU 3 | Percent of doses in which the ternary is present |
|---|---|---|---|
| *Clostridium bifermentans* | *Faecalibacterium prausnitzii* | *Ruminococcus Obeum* | 75 |
| *Clostridium bifermentans* | *Ruminococcus obeum* | *Ruminococcus torques* | 75 |
| *Clostridium bifermentans* | *Ruminococcus obeum* | *Ruminococcus* sp. 5_1_39BFAA | 75 |
| *Blautia* sp. M25 | *Clostridium bifermentans* | *Faecalibacterium prausnitzii* | 75 |
| *Blautia* sp. M25 | *Clostridium bifermentans* | *Ruminococcus torques* | 75 |
| *Clostridium bifermentans* | *Faecalibacterium prausnitzii* | *Ruminococcus* sp. 5_1_39BFAA | 75 |
| *Clostridium bifermentans* | *Faecalibacterium prausnitzii* | *Ruminococcus torques* | 75 |
| *Clostridium bifermentans* | *Ruminococcus* sp. 5_1_39BFAA | *Ruminococcus torques* | 75 |
| *Blautia* sp. M25 | *Clostridium bifermentans* | *Ruminococcus obeum* | 75 |

TABLE 21-continued

Ternary OTU combinations in administered spore ecology doses that result in augmentation or engraftment of the OTUs Eubacterium rectale, Faecalibacterium prausnitzii, Oscillibacter sp. G2, Ruminococcus lactaris, and Ruminococcus torques.

| OTU 1 | OTU 2 | OTU 3 | Percent of doses in which the ternary is present |
|---|---|---|---|
| Blautia sp. M25 | Clostridium bifermentans | Ruminococcus sp. 5_1_39BFAA | 75 |
| Clostridium bifermentans | Ruminococcus bromii | Ruminococcus obeum | 75 |
| Blautia sp. M25 | Clostridium bifermentans | Gemmiger formicilis | 75 |
| Clostridium bifermentans | Faecalibacterium prausnitzii | Ruminococcus bromii | 75 |
| Clostridium bifermentans | Gemmiger formicilis | Ruminococcus obeum | 75 |
| Clostridium bifermentans | Gemmiger formicilis | Ruminococcus sp. 5_1_39BFAA | 75 |
| Clostridium bifermentans | Ruminococcus bromii | Ruminococcus torques | 75 |
| Clostridium bifermentans | Faecalibacterium prausnitzii | Gemmiger formicilis | 75 |
| Blautia sp. M25 | Clostridium bifermentans | Ruminococcus bromii | 75 |
| Clostridium bifermentans | Gemmiger formicilis | Ruminococcus torques | 75 |
| Clostridium bifermentans | Ruminococcus bromii | Ruminococcus sp. 5_1_39BFAA | 75 |
| Clostridium bifermentans | Gemmiger formicilis | Ruminococcus bromii | 75 |

TABLE 22

Selected OTUs that may be present in the tables, specification, or in the art with their alternate names, e.g., the current name used per NCBI. Reference 1 is Kaur et al., "Hungatella effluvii gen. nov., sp. nov., an obligately anaerobic bacterium isolated from an effluent treatment plant, and reclassification of Clostridium hathewayi as Hungatella hathewayi gen. nov., comb. nov.", Int J Sys Evol Microbiol, March 2014, vol. 64, pp. 710-718. Reference 2 is Gerritsen et al., "Characterization of Romboutsia ilealis gen. nov., sp. nov., isolated from the gastro-intestinal tract of a rat, and proposal for the reclassification of five closely related members of the genus Clostridium into the genera Romboutsia gen. nov., Intestinibacter gen, nov., Terrisporobacter gen. nov. and Asaccharospora gen. nov.", Int J Sys Evol Microbioi, May 2014, vol. 64, pp. 1600-1616.

| OTU name | Alternate OTU name | Reference |
|---|---|---|
| Clostridium hathewayi | Hungatella hathewayi | 1 |
| Clostridium lituseburense | Romboutsia lituseburense | 2 |
| Clostridium bartlettii | Intestinibacter bartlettii | 2 |
| Clostridium glycolicum | Terrisporobacter glycolicus | 2 |
| Clostridium mayombei | Terrisporobacter mayombei | 2 |
| Clostridium irregulare | Asaccharospora irregularis | 2 |

SEQUENCE LISTING (2047 sequences)

SEQ ID NO: 1 - DNA, 1532 bp, Abiotrophia defectiva
atgagagtttgatcctggctcaggatgaacgctggcggcgtgcctaacacatgcaagtcgaacggagattacggacggaagttttcggatggaagcctgtaattcttagtggcggacgggtgagtaacgcgtgggcaacctgccctatacagggggatagcagctggaaacggctggtaagaccgcataagtcggttaaatcgcatgatttgatcgggaaatgagcaatcaggtataggatgggcccgcgtccgattagccagttggcagggtaaaagcctaccaaagcgacgatcggtagccggactgagaggtcggacggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgatgacggtacctgactaagaagccccggctaactacgcgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaaaactgacgctgaggctcgaaagcgtgggtagcaaacaggattagataccctggtagtccacgctgtaaacgatgaatactaggtgctgggatgcataagcatttcggtgccgtcgcaaacgcattaagtattccacctggggagtacgttcgcaagaatgaaactcaaaggaattgacggggacccgcacaagcggtggagcatgtggtttaattcgacgcaacgcgaagaaccttacccggtcttgagatcctcctgaatactgagtaatgtcagtagtccttcgggacaggagagacaggtggtgcatggttgtcgtcagctcgtgtcgtgagatgttgggttaagtcccgcaacgagcgcaacccctatttttagtagccagcggttcggccgggcactctaaagagactgccgaggataactcggaggaaggcggggatgacgtcaaatcatcatgccccttatgaccggggctacacacgtgctacaatggcagttacagagggaagcgaaggcgtgagccggagcaaatctcagaaaggctgcctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtggcctaaccgtaagggaggagctgccgaaggcaggtctggtgactggggtgaagtcgtaacaaggtagccgtatcggaaggtgcggctggatcacctcctttct

SEQ ID NO: 2 - DNA, 1407 bp, Abiotrophia para-adiacens
agagtttgatcatggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgt

SEQ ID NO: 3 - DNA, 1328 bp, Abiotrophia sp. oral clone P4PA_155 P1
gacgaacgctggcggtgtgcctaatacatgcaagtcgaacgagtggcgaacgggtgagtaacacgtgggtaacctacctcatagtgggggataacagtcggaaacgactgctaataccgcatagggaaagtcgctaagagatggacccgcggtgcattagctggttggtagggtaaaggcctaccaaggcgatgatgcatagccgacctgagagggtgatcggccacattgggactgagactcggcccagactcctacgggaggcagcagtagggaatcttccgcaatggacgcaagtctgacggagcaacgccgcgtgagtgaagaaggtcttcggatcgtaaagctctgttgttggagaagatgacggtatctaaccggaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgactgacgctgaggctcgaaagcgtggggagcaaacaggattagataccctggtagtccacgccgtaaacgatgagtgctaagtgttggagcttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctataactagttgccagcatggggactctagttagactgccggtgacaaaccggaggaaggtggggatgacgtcaaatcatcatgccccttatgacctgggctacacacgtgctacaatggatggcaacgagcagcgaactcgcgagggtaagcgaatctctaccattctcagttcggatgtagtctgcaacccgactacagaagccggaatcgctagtaatcgcggatcagcacgccgcggtgaatacgttcccgggtcttgtacacaccgcccgtcacaccacgagagtttgtaacacccgaagccggtgcctagggagccgtcgaaggtgggatagatgattggggtgaagtcgtaacaaggtagccgtatcggaaggtgc

SEQ ID NO: 4 - DNA, 1533 bp, Acetanaerobacterium elongatum
gagtttgatcctggctcaggacgaacgctggcggcgcgcctaacacatgcaagtcgagcggagtaatgtctaacacagagcggtgaaggatgattcactgttgtgtgttagatgttacttagcggcggacgggtgagtaacacgtgagcaatctgcctttcagagggggataacgtttggaaacgaacgctaataccgcatgatatacctaggtcgcatgaccttggtatcaaaggagcaatccgctgaaagatgagctcgcgtccgattaggtagttggtgaggtaacggcccaccaagcctgcgatcggtagccggactgagaggtcgatcggccacattgggactgagacacggcccagactcctacgggaggcagcagtgggggatattgcacaatggaggaaactctgatgcagcgacgccgcgtgagggaagaaggtcttcggattgtaaacctctgtcttcggggacgataatgacggtacccgaggaggaagccacggctaactacgtgccagcagccgcggtaatacgtaggtggcaagcgttgtccggaattactgggtgtaaagggagcgtaggcgggctcgcaagttgaatgttaaatctaccggctcaaccggtaaccgcgttcaaaactgcgagtcttgagtgtagtagaggcaggcggaattcctagtgtagcggtgaaatgcgtagatattaggaggaacaccagtggcgaaggcggcctgctgggcttttactgacgctgatgctcgaaagcatggggagcaaacaggattagataccctggtagtccatgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgcacgcattacctagagatagggaagcccttcggggcgtgtagacaggtggtgcatggttgtcgtcagctcgtgtcgtgagatgttgggttaagtcccgcaacgagcgcaacccttacagttagttgctacgcaagagcactctaacaggactgccgttgacaaaacggaggaaggtggggatgacgtcaaatcatcatgccccttatgacctgggccacacacgtactacaatggccatcaacagaggggtgcaaagccgcgaggcagagcaaatctcaaaaaatggtctcagttcggattgcaggctgcaactcgcctgcatgaagccggaattgctagtaatcgcgaatcagcatgtcgcggtgaatacgttcccgggccttgtacacaccgcccgtcacaccatgagagccggtaacacccgaagcttgtagtctaaccgcaaggaggacgcaattgaaggtggggctggtaattggggtgaagtcgtaacaaggtagccgtatcggaaggtgcggctggatcacctcctta

SEQ ID NO: 5 - DNA, 1464 bp, Acetivibrio cellulolyticus
gacgaacgctggcggcgtgcttaacacatgcaagtcgagcggagaatatagcaatatattcttagcggcggacgggtgagtaacgcgtgggcaatctgcctcatacagggggataacactgggaaactagtgctaataccgcataaaatagtgaagtggcatcactttactatcaaaggagcaatccggtgtgagatgagcccgcgtccgattagctagttggtggggtaacggcccaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggatgaaggttttcggattgtaaacttctttgattggggacgataatgacggtacccaaaaaacaagccacggctaactacgtgccagcagccgcggtaatacgtaggtggcaagcgttgtccggatttactgggtgtaaagggcgtgtaggcggggatgcaagtcagatgtgaaattcggggctcaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacataccattgacgtayctagagataggtatttcttcgggacaatggatacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagcgaagccgtgaggtggagcaaatctccaaaaatagtcccagttcagattgtaggctgaaactcgcctacatgaagtcggaattgctagtaatggcaggtcagcatactgccgtgaatacgttcccgggccttgtacacaccgcccgtcacaccatgagagtctgcaacacccgaagtcagtagtctaactgtaaagaggacgctgccgaaggtggggccgatgattggggtgaagtcgtaacaaggtagccgtatcggaaggtgc

SEQ ID NO: 6 - DNA, 1529 bp, Acetivibrio ethanolgignens
tgatcctggctcaggatgaacgctggcggcgtgcttaacacatgcaagtcgaacgaagcacttaaaacagattggaatagcttgctaggaagagaagttttatttgactgagtggcggacgggtgagtaacgcgtgggtaacctgcctcacacagggggataacagttagaaatgactgctaataccgcataatatgcagcctcgcatgagactgctttgaaaactccggtggtgtgagatgggcccgcgtctgattagccagttggcagggtaacggcctaccaaagcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtaggtggttcggcaagtctgatgtgaaagcccggggctcaaccccgggactgcattggaaactgtcggacttgagtgctggagaggtaagtggaattcctagtgtagcggtgaaatgcgtagatattaggaggaacaccagtggcgaaggcggcttactggacagtaactgacactgaggctcgaaagcgtggggagcaaacaggattagataccctggtagtccacgccgtaaacgatgaatactaggtgtcggggcccataagggcttcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaggtcttgacatcccgacgaccggcccgtaacggggtcctttcttcggaacgtcggtgacaggtggtgcatggttgtcgtcagctcgtgtcgtgagatgttgggttaagtcccgcaacgagcgcaacccctgttcttagtagccagcagttcggctgggcactctagggagactgccagggataacctggaggaaggtggggatgacgtcaaatcatcatgccccttatgatctgggctacacacgtgctacaatggcgtaaacaaagggaagcgaccctgtgaaggtaagcaaatctcaaaaataacgtctcagttcggattgtagtctgcaactcgactacatgaagctggaatcgctagtaatcgcaaatcagaatgttgcggtgaatacgttcccgggtcttgtacacaccgcccgtcacaccatgggagtcggatatgcccgaagtcagtgacctaaccgcaaggagggagctgccgaaggtggagccgatgactggggtgaagtcgtaacaaggtagccgtatcggaaggtgcggctggatcacctcctt

SEQ ID NO: 7 - DNA, 1480 bp, Acetobacter aceti
gagtttgattctggctcagagcgaacgctggcggcatgcttaacacatgcaagtcgcacgaaggcttcggccttagtggcggacgggtgagtaacgcgtaggaatctatccatgggtgggggataactccgggaaactggagctaataccgcatgatacctgagggtcaaaggcgcaagtcgcctgtggaggagtctgcgtttgattagcttgttggtggggtaaaggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtatgagagagggttgtggaattctcagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatggagaggctgtattcagagatggatatttcccgcaagggacctcttgcacaggtgctgcatggctgtcgtcagctcgtgtcgtgagatgttgggttaagtcccgcaacgagcgcaacccttatctttagttgccagcatgtttgggtgggcactctaaagagactgccggtgacaagccggaggaaggtggggatgacgtcaagtcctcatggcccttatgtcctgggctacacacgtgctacaatggcggtgacagtgggaagctagatggcgacatcgtgccgatctctaaaaaccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 8 - DNA, 1442 bp, Acetobacter fabarum
agcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttacacagtcagatgtgaaatccccgggcttaacctgggagctgcatttgatacgtgtagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacc

SEQ ID NO: 9 - DNA, 1443 bp, Acetobacter lovaniensis
tgagttttgatcctggctcagagcgaacgctggcggcatgcttaacacatgcaagtcgcacgaacctttcggggttagtggcggacgggtgagtaacgcgtaggaatctgtccacgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttacacagtcagatgtgaaatccccgggcttaacctgggagctgcatttgatacgtgtagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctagatgttgggtaactttgttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtccagcgactggggtgaagtcgtac

SEQ ID NO: 10 - DNA, 1442 bp, Acetobacter malorum
agcgaacgctggcggcatgcttaacacatgcaagtcgcacgaaggcttcggccttagtggcggacgggtgagtaacgcgtaggaatctatccacgggtgggggataactccgggaaactggagctaataccgcatgatacctgagggtcaaaggcgcaagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagttagatgtgaaatccccgggcttaacctgggagctgcatttaatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtaacttagttactcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcgatgacaatgggaagctagatggcgacatcgtgctgatctcaaaaagtcgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacc

SEQ ID NO: 11 - DNA, 1401 bp, Acetobacter orientalis
tgagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcgagtcgcctgtggaggagcctgcgtttgattagcttgttggtggggtaatggcctaccaaggcgatgatcaatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgtatgggtaggctgtgtccagagatgggcatttcccgcaagggacctaccgcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaaaccgtctcagttcggattgtactctgcaactcgagtacatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgca

SEQ ID NO: 12 - DNA, 1479 bp, Acetobacter pasteurianus
gagtttgattctggctcagagcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgacttagtcattcagtgtcgcacttaacgcgttaagcacaccgcctggggagtacggccgcaaggttgaaactcaaaggaattgacgggggcccgcacaaggcgtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgagagtgggaagctaggtggtgacaccatggtgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagcgaccacggtcgggtcagcgactggggtgaagtcgtaacaaggtagccgtaggggaacctgcggctggatcacctccttt

SEQ ID NO: 13 - DNA, 1440 bp, Acetobacter pomorum
agcgaacgctggcggcatgcttaacacatgcaagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtatgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtaacttagttattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgcaagcagagatgtttgtttcccgcaagggacctctaacacaggtgctgcatggctgtcgtcagctcgtgtcgtgagatgttgggttaagtcccgcaacgagcgcaacccctatctttagttgccatcaggttgggctgggcactctagagagactgccggtgacaagccggaggaaggtggggatgacgtcaagtcctcatggcccttatgtcctgggctacacacgtgctacaatggcggtgacagtgggaagctaggtggtgacaccatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacc

SEQ ID NO: 14 - DNA, 1412 bp, Acetobacter syzygii
agcgaacgctggcggcatgcttaacacatgcaagtcgcacgaacctttcggggttagtggcggacgggtgagtaacgcgtaggaatctgtccatgggtgggggataactctgggaaactggagctaataccgcatgatacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtacagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctagatgttgggtgactttgtcattcagtgtcgcagttaacgcgttaagcacaccgcctggggagtacggccgcaaggttgaaactcaaaggaattgacgggggcccgcacaagcggtggagcatgtggtttaattcgaagcaacgcgcagaaccttaccagggcttgaatgtagaggctgtattcagagatggatatttcccgcaagggacctctaacacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggtgacatcgtgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtg

SEQ ID NO: 15 - DNA, 1443 bp, Acetobacter tropicalis
  modified_base (9)..(9): a, c, t, g, unknown or other
tgagttganctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgcaagtcgcctgtggaggagcctgcgttcgattagcttgttggtggggtaatggcctaccaaggcgatgatcgatagctggtctgagaggatgatcagccacactgggactgagacacggcccagactcctacgggaggcagcagtggggaatattggacaatgggggcaaccctgatccagcaatgccgcgtgtgtgaagaaggttttcggattgtaaagcactttcggcggggacgatgatgacggtacccgcagaagaagccccggctaacttcgtgccagcagccgcggtaatacgaagggggctagcgttgctcggaatgactgggcgtaaagggcgtgtaggcggtttgtacagtcagatgtgaaatccccgggcttaacctgggagctgcatttgatacgtgcagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggcaacttagttgttcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgtatgtgtaggctgtgtccagagatgggcatttcccgcaagggacctacagcacaggtgctgcatggctgtcgtcagctcgtgtcgtgagatgttgggttaagtcccgcaacgagcgcaacccctatctttagttgccagcatgtttgggtgggcactctagagagactgccggtgacaagccggaggaaggtggggatgacgtcaagtcctcatggcccttatgtcctgggctacacacgtgctacaatggcggtgacagtgggaagctagatggcgacatcgtgctgatctctaaaagccgtctcagttcggattgcactctgcaactcgagtgcatgaaggtggaatcgctagtaatcgcggatcaagcatgccgcggtgaatacgttcccgggccttgtacacaccgcccgtcacaccatgggagttggtttgaccttaagccggtgagcgaacccagctaatggggcgcagccgaccacggtcgggtcagcgactggggtgaagtcgtac

SEQ ID NO: 16 - DNA, 1475 bp, Acetobacteraceae bacterium AT-5844
agagtttgatcctggctcagagtgaacgctggcggcatgcttaacacatgcaagtcgtgcgccccgcaaggggagcggcggacgggtgagtaacacgtaggaatgtgtccggaggtgggggataaccctgggaaactagggctaataccgcatatgggctgaggcccaaagccgtgaggcgccatcggagtagcctgcgcctgattagctagttggtggggtaaaggcctaccaaggcgacgatcagtagctggtctgagaggacgatcagccacactgggactgagacacggcccagactcctacgggaggcagcagtggggaatattggacaatgggcgcaagcctgatccagcaatgccgcgtgtgtgaagaaggtcttcggatcgtaaagcactttcggcggggacgatgatgacggtacccgcagaagaagccccggctaacttcgtgccagcagccgcggtaatacgaagggggctagcgttactcggaattactgggcgtaaagggcgcgtaggcggcgttccaagttaggcgtgaaagtcctgggctcaacctgggaactgcgcttaagactggagtgcttgaggatggaagagggttgtggaattcccagtgtagaggtgaaattcgtagatattgggaagaacaccggtggcgaaggcggcaacctggtccattactgacgctgaggcgcgatagcgtggggagcaaacaggattagataccctggtagtccacgccgtaaacgatgtgcgctggatgttgggggtcctagaccttcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagctcttgacatgggtaggaccggtgcagagatgcacttttcccgcaagggacctaccgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaacgggatgccaggcagcgatgccgagccgatcccaaaaagccgtctcagttcagattgcagcctgcaactcggctgcatgaaggtggaatcgctagtaatcgcggatcagcacgccgcggtgaatacgttcccgggccttgtacacaccgcccgtcacaccatgggagttggttttaccttaagtcggtgcggtaaccgcaaggagctagccgaccacggtaggatcagtgactggggtgaagtcgtaacaaggtagccgtaggggaacctgcggctggatcacct

SEQ ID NO: 17 - DNA, 1506 bp, Acholeplasma laidlawii
tatatggagagtttgatcctggctcaggatgaacgctggcggcgtgcctaatacatgcaagtcgaacgaagcatcttcggatgcttagtggcgaacgggtgagtaacacgtagataacctacctttaactcgaggataactccgggaaactggagctaatactggataggatgtgtgcatgaaaaaaacacatttaaagatttatcggtttaagaggggtctgcggcgcattagttagttggtggggtaaaagcctaccaagacgatgatgcgtagccggactgagaggtctaccggccacattgggactgagaacggcccaaactcctacgggaggcagcagtagggaattttcggcaatgggggaaaccctgaccgagcaacgccgcgtgaacgacgaagtacttcggtatgtaaagttcttttatatgggaagaaaaattaaaaattgacggtaccatatgaataagccccggctaactatgtgccagcagccgcggtaatacatagggggcgagcgttatccggatttactgggcgtaaagggtgcgtaggtggttataaaagtttgtggtgtaagtgcagtgcttaacgctgtgaggctatgaaaactatataactagagtgagacagaggcaagtggaattccatgtgtagcggtaaaatgcgtaaatatatggaggaacaccagtggcgaaggcggcttgctgggtctatactgacactgatgcacgaaagcgtggggagcaaacaggattagataccctggtagtccacgccgtaaacgatgagaactaagtgttggccaaaaggtcagtgctgcagttaacgcattaagttctccgcctgagtagtacgtacgcaagtatgaaactcaaaggaattgacgggaccccgcacaagcggtggatcatgttgtttaattcgaagatacacgaaaaaccttaccaggtcttgacatactctgcaaaggcttagaaataagttcggaggctaacagatgtacaggtggtgcacggttgtcgtcagctcgtgtcgtgagatgttgggttaagtcccgcaacgagcgcaacccttattgctagttaccatcattaagttggggactctagcgagactgccagtgataaattggaggaaggtggggatgacgtcaaatcatcatgccccttatgacctgggctacaaacgtgatacaatggctggaacaaagagaagcgatagggtgacctggagcgaaactcacaaaaacagtctcagttcggattggagtctgcaactcgactccatgaagtcggaatcgctagtaatcgcaaatcagcatgttgcggtgaatacgttctcggggtttgtacacaccgcccgtcaaaccacgaaagtgggcaatacccaacgccggtggcctaacccgaaagggagggagccgtctaaggtagggtccatgattggggttaagtcgtaacaaggtatccctacgggaacgtggggatggatcacctcctttct

SEQ ID NO: 18 - DNA, 1523 bp, Achromobacter denitrificans
  modified_base (847)..(847): a, c, t, g, unknown or other
  modified_base (1509)..(1509): a, c, t, g, unknown or other
agagtttgatcatggctcagattgaacgctagcgggatgccttacacatgcaagtcgaacggcagcacggacttcggtctggtggcgagtggcgaacgggtgagtaatgtatcggaacgtgcccagtagcgggggataactacgcgaaggcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaataccccggggaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcanctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcctgaagagatttaggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggntggatcacctcctt

SEQ ID NO: 19 - DNA, 1534 bp, Achromobacter piechaudii
ttaaactgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgtaagaccttgcactattagagcggccgatatcggattagctagttggtggggtaatggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaactggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 20 - DNA, 1534 bp, Achromobacter xylosoxidans
ttaaactgaagagtttgatcctggctcagattgaacgctagcgggatgccttacacatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaatacctcgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagagccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctcctttc

SEQ ID NO: 21 - DNA, 1545 bp, Acidaminococcus fermentans
agagtttgatcctggctcaggacgaacgctggcggcgtgcttaacacatgcaagtcgaacggagaactttcttcggaatgttcttagtggcgaacgggtgagtaacgcgtaggcaacctgccctctggttggggacaacattccgaaagggatgctaataccgaatgagatcctctttccgcatggagagaggatgaaagatggcctctacttgtaagctatcgccagaagatgggcctgcgtctgattagcttgtaggtgaggtaacggctcacctaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggccttcgggttgtaaaactctgttgtcagggacgaaagcaccgatctataatacattttggtgttgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacccagagatgggtccccttcttcggaagcacgaaaacaggtggtgcatggctgtcgtcagctcgtgtcgtgagatgttgggttaagtcccgcaacgagcgcaacccttatcctatgttaccagcacgtaatggtggggactcataggagactgccagggataacctggaggaaggcggggatgacgtcaagtcatcatgccccttatgtcttgggctacacacgtactacaatggtcggcaacaaagggcagcgaagccgcgaggcggagccaatcccagaaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacct

SEQ ID NO: 22 - DNA, 1489 bp, Acidaminococcus intestini
ctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagc

SEQ ID NO: 23 - DNA, 1556 bp, Acidaminococcus sp. D21
ttggagagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatgattggggtgaagtcgtaacaaggtagccgttcgagaacgagcggctggatcacctcctttct

SEQ ID NO: 24 - DNA, 1451 bp, Acidilobus saccharovorans
tccggttgatcctgccggacccgactgctatcggggtgaggctaagccatgggagtcgcgcgcccagccgccgctgggcgggcgcacggctgagtaacacgtagctaacctaccctcgggacggggataaccccgggaaactggggctaatccccgataggcgagggggcctggaatggtccctcgccgaaagggaccctggggggttatcgcctggggtccgcccgaggatggggctgcggcccatcatggtagttggcggggtaatggcccgccaagccgacgacgggtaggggccgtgggagcgggagcccccagatgggccctgagacaagggcccaggccctacggggcgcaccaggcgcgaaacctccgcaatgcgggaaaccgtgacggggtcaccccgagtgctcccgtaagggagcttttccccgctgcaaggaggcgggggaataagcggggggcaagtctggtgtcagccgccgcggtaataccagccccgcgagtggtcgggacgtctactgggcctaaagcgcccgtagccggccccgtaagtccctcctgaaagccctgggctcaacccagggagtgggggggatactgcggggctagggggcgggagaggccgggggtaccccaggggtaggggcgaaatccgataatccctgggggaccaccagtggcgaaagcgcccggctggaacgcgcccgacggtgaggggcgaaagccgggggagcgaaccggattagatacccgggtagtcccggctgtaaacgatgcgggctaggtgtcgggcgggcgttagagcccgcccggtgccgcagggaagccgttaagcccgccgcctggggagtacggccgcaaggctgaaactttaaggaattggcgggggggcacacaaggggtggagcctgcggctcaattggagtcaacgccgggaacctcaccgggggcgacagcaggatgacggccaggctaacgaccttgcccgacgcgctgaggggaggtgcatggccgtcgccagctcgtgctgtgaagtgtcctgttaagtcaggcaacgagcgagacccccgcccctagttgcgacccggcgggagaccgttggggcacactagggggactgccgccgctaaggcggaggaaggagggggccacggcaggtcagcatgcccctaaaccccgggttgcacgcgggctacaatggcgggracagcgggatccgaccccgaaagggggaggcaatccctcaaaccccgccgtagtcgggattgggggctgtaactcgcccccatgaacctggaatccctagtaaccgcgcgtcaacatcgcgcggtgaatacgtccctgccccttgtacacactgcccgtcgctccacctgagagaaggaggggtgaggcttcctccttcgggagggagtcgaacccctccttctcgaggggggagaagtcgt

SEQ ID NO: 25 - DNA, 1524 bp, Acidithiobacillus ferrivorans
agagtttgatcctggctcagattgaacgctggcggcatgcctaacacatgcaagtcgaacggtagcaggccttcgggtgctgacgagtggcggacgggtgagtaatgcgtaggaatctgtcttttagtgggggacaacccagggaaacttgggctaataccgcatgagccctgagggggaaagcgggggatcttcggacctcgcgctaagagaagagcctacgtctgattagctagttggtagggtaaaggcctaccaaggcgacgatcagtagctggtctgagaggacgaccagccacactgggactgagacacggcccagactcctacgggaggcagcagtggggaatttttcgcaatgggggcaaccctgacgaagcaatgccgcgtggatgaagaaggccttcgggttgtaaagtcctttcgtgggggacgaaaaggtggttcctaatacgagctgctgttgacgtgaacccaagaagaagcaccggctaactccgtgccagcagccgcggtaatacggggggtgcaagcgttaatcggaatcactgggcgtaaagggtgcgtaggcggtacgttaggtctgtcgtgaaatccccgggctcaacctgggaatggcggtagaaaccggcgaactagagtatgggagagggtggtggaattccaggtgtagcggtgaaatgcgtagagatctggaggaacatcagtggcgaaggcggccacctggcccaatactgacgctgaggcacgaaagcgtggggagcaaacaggattagataccctggtagtccacgccctaaacgatgaatactagatgtttggtacctagcgtactgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtccggaatcctgcagagatgcgggagtgcccttcggggaatcggaacacaggtgctgcatggctgtcgtcagctcgtgtcgtgagatgttgggttaagtcccgcaacgagcgcaacccttgtccttagttgccagcggttcggccgggcactctagggagactgccggtgacaaaccggaggaaggtggggatgacgtcaagtcctcatggcctttatgtccagggctacacacgtgctacaatggcgcgtacagagggacgccaaaccgcgaggtggagcagaccccagaaagcgcgtcgtagttcggattgcagtctgcaactcgactgcatgaagtcggaatcgctagtaatcgcggatcagcatgccgcggtgaatacgttcccgggccttgtacacaccgcccgtcacaccatgggagtagattgtaccagaagcggctagcctaaccttcgggagggcggttaccacggtatggtttatgactggggtgaagtcgtaacaaggtagccgtaggggaacctgcggctggatcacct

SEQ ID NO: 26 - DNA, 1332 bp, Acidovorax sp. 98-63833
tgagtttgatcctggctcagattgaacgctggcggcatgccttacacatgcaagtcgaacgagtggcgaacgggtgagtaatacatcggaacgtgcctagtagtgggggataactactcgaaagagtggctaataccgcatgaggaaaggtgctactagagcggccgatggcagattaggtagttggtgggataaaagcttaccaagccaacgatctgtagctggtctgagaggacgatcagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgatgacggtaccgtaagaataagcaccggctaactacgtgccagcagccgcggtaatacgtagggtgcaagcgttaatcggaattactgggcgtaaagcgtgcgcaggcggttttgtaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctactgacgctcatgcacgaaagcgtggggagcaaacaggattagataccctggtagtccacgccctaaacgatgtcaactggttgttgggtactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgcacaggtgctgcatggctgtcgtcagctcgtgtcgtgagatgttgggttaagtcccgcaacgagcgcaacccttgccattagttgctacggcactctaatgggactgccggtgacaaaccggaggaaggtggggatgacgtcaagtcctcatggcccttataggtggggctacacacgtcatacaatggctggcaaagggttgccaacccgcgagggggagctaatcccatccagtcgtagtccggacgcagtctgcaactcgactgcggaagtcggaatcgctagtaatcgtggatcagcatgtcacggtgaatacgttcccgggtcttgtacacaccgcccgtcacaccatgggagcgggtctcgccagaagtaggtgcctagggcgcttaccacggcggggttcgtgactggggtgaagtcgtaacaaggtagccgta

SEQ ID NO: 27 - DNA, 1539 bp, Acinetobacter baumannii
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 28 - DNA, 1607 bp, Acinetobacter calcoaceticus
cactactcacgcgttgggagctctcccatatggtcgacctgcaggcggccgcgaattcactagtgattagagtttgattatggctcagattgaacgctggcggcaggcttaacacatgcaagtcgagcggagtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactgaagttaataccttcagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcacgggccttgtacacaccgcccgtcacaccatgggagtttgttgcaccagaagtaggtagtctaaccgcaagggggacgcttaccacggtgtggccgatgactggggtgaagtcgtaacaaggtaaccgtaaatcgaattcccgcggccgccatggcggccggagctg

SEQ ID NO: 29 - DNA, 1296 bp, Acinetobacter genomosp. C1
attgaacgctggcggcaggcttaacacatgcaagtcgagcgagcggcggacgggtgagtaatgcttaggaatctgcctattagtgggggacaacattccgaaaggaatgctaataccgcatacggaaaggcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagtcatgccgcgtgtgtgaggaaggccttttggttgtaaagcactttaagcgaggaggaggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaactgacgctgaggtacgaaagcatggggagcaaacaggattagataccctggtagtccatgccgtaaacgatgtctactagccgttggggctttagtggcgcggctaacgcgataagtagaccgcctggggagtacggtcgcaagactaaaactcaaatgaattgacgggggcccgcacaagcggtggagcatgtggtttaattcgatgcaacgcgaagaaccttacctggccttgacatatacaggtgctgcatggctgtcgtcagctcgtgccgtgagatgttgggttaagtcccgcaacgagcgcaacccttttccttacttgccagcatatgggaactttaaggatactgccagtgacaaactggaggaaggcggggacgacgtcaagtcatcatggcccttacggccagggctacacacgtgctacaatggtcggcaaagggttgctacctagcgataggatgctaatctcaaccgatcgtagtccggatggagtctgcaactcgactccagaagtcggaatcgctagtaatcgcggatcagaatgccgcggtgaatacgttcccgggccttgtacacaccgcccgtcacaccatgggagtttgttgcaccagaagtaggtgtctaggacgcttaccacggtgtggccgatgactggggtg

SEQ ID NO: 30 - DNA, 1540 bp, Acinetobacter haemolyticus
ttaaactgaagagtttgatcatggctcagattgaacgctggcggcaggcttaacacatgcaagtcgagcggggaagtgtagcttgctacattacctagcggcggacgggtgagtaatgcttaggaatctgcctattagtgggggacaacattccgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctactctagttaatacctagagatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagtcgtaacaaggtagccgtaggggaacctgcggctggatcacctcctta

SEQ ID NO: 31 - DNA, 1447 bp, Acinetobacter johnsonii
cctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttagattaatactctaggatagtggacgttactcgcagaataagcaccggctaactctgtgccagcagccgcggtaatacagagggtgcgagcgttaatcggatttactgggcgtaaagcgtgcgtaggcggcttcttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 32 - DNA, 1537 bp, Acinetobacter junii
aactgaagagtttgatcatggctcagattgaacgctggcggcaggcttaacacatgcaagtcgagcggagatgaggtgcttgcaccttatcttagcggcggacgggtgagtaatgcttaggaatctgcctattagtgggggacaacattccgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaaccctgatccagccatgccgcgtgtgtgaagaaggccttatggttgtaaagcactttaagcgaggaggaggctactgagactaatactcttggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 33 - DNA, 1449 bp, Acinetobacter lwoffii
gacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggcagatgactggggtgaagtcgtaacaaggtagccgtaggggaacctgcggctggatcacctcctta

SEQ ID NO: 34 - DNA, 1517 bp, Acinetobacter parvus
agagtttgatcatggctcagattgaacgctggcggcaggcttaacacatgcaagtcgagcggggattgggtgcttgcacctaatcttagcggcggacgggtgagtaatgcttaggaatctgccatttagtgggggacaacattccgaaagggatgctaataccgcatacgccctacgggggaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctacctggattaatactctaggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggccgatgactggggtgaagtcgtaacaaggtagccgtaggggaacctgcggctg

SEQ ID NO: 35 - DNA, 1539 bp, Acinetobacter radioresistens
tttaactgaagagtttgatcatggctcagattgaacgctggcggcaggcttaacacatgcaagtcgagcggatgaaggtagcttgctaccggattcagcggcggacgggtgagtaatgcttaggaatctgcctattagtgggggacaacgttccgaaaggagcgctaataccgcatacgtcctacgggagaaagcaggggacctttgggccttgcgctaatagatgagcctaagtcggattagctagttggtagggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctacctagattaatactttaggatagtggacgttactcgcagaataagcaccggctaactctgtgccagcagccgcggtaatacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggctggatcacctcctta

SEQ ID NO: 36 - DNA, 1466 bp, Acinetobacter schindleri
ggcggcaggcttaacacatgcaagtcgagcggggaaaggtaccttgctacctgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagagagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactgggacgaagtcgtaacaaggta

SEQ ID NO: 37 - DNA, 1291 bp, Acinetobacter sp. 56A1
gcttgctactggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtggaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtg

SEQ ID NO: 38 - DNA, 1513 bp, Acinetobacter sp. CIP 101934
ctcagattgaacgctggcggcaggcttaacacatgcaagtcgagcggggaaggttgcttcggtaactgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttttggttgtaaagcactttaagcgaggaggaggctcctttagttaatacctaaagtgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccagcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtagccgtaggggaacctgcggttggatcacctcc

SEQ ID NO: 39 - DNA, 1494 bp, Acinetobacter sp. CIP 102143
tggctcagattgaacgctggcggcaggcttaacacatgcaagtcgagcggggattgggtgcttgcacctaatcttagcggcggacgggtgagtaatgcttaggaatctgccatttagtgggggacaacattccgaaagggatgctaataccgcatacgccctacgggggaaagcaggggatcttcggaccttgcgctaaatgatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaagcctgatccagccatgccgcgtgtgtgaagaaggccttttggttgtaaagcactttaagcgaggaggaggctacctggattaatactctaggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagaaactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttaggggggacgcttaccacggtgtggccgatgactggggtgaagtcgtaacaaggtagccgtagggga

SEQ ID NO: 40 - DNA, 1465 bp, Acinetobacter sp. CIP 53.82
acatgcaagtcgagcggggatagggtgcttgcacctgattcctagcggcggacgggtgagtaaagcttaggaatctgcctattagtgggggacaacattccgaaagggatgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggcgctctaggataataccctagatgcgtggacgttactcgcagaataagcaccggctaactctgtgccagcagccgcggtaatacagagggtgcgagcgttaatcggatttactgggcgtaaagcgcgcgtaggtggctaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccttagggaggacgcttaccacggtgtggccgatgactggggtgaagtcgtaacaaggtagccgtaggggaacc

SEQ ID NO: 41 - DNA, 1280 bp, Acinetobacter sp. M16-22
  modified_base (489)..(489): a, c, t, g, unknown or other
cgagcggacgggtgagtgatgcttgggagtctgcctgttagtgggggacaacttcttacaggggatgctaataccgcccacatcctaccggagaaagcaggggatcttccttccttgctctagtagatgaacctgcctcggattaactagttggtggggtaaaggcctacccaggcgaccatctatcccgggtctgagaggatgatccaccacactgggactgagacacagcccagactcctaccggaggcaggagtggggaatataggacaatggggggaaccctgatccatgcatgccgcgtgtgtgaagaaggccttatggttgtaaagcactttaatcgaggaggaggctactttagttagtacctagagatagtggacgttactcgcagaataagcaccggctaactctgtgccaccagccgcggtaatacagagggtgcgagcgttaatcggatttactgggcgtaaagcgcgcgcaggcggntatcaagtcggatgtgaaatccccgagctcaacttgggaattgcattcgatactggcgagctagagtatgggagaggagggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccggtggtgcctttgaggcgttagttgcgcagctaacgcgataagtagaccgcctggggagtacggtcgcaagattaaaactcaaatgaattgacgggggcccgcacaagcggtggagcatgtggtttaattcgatgcaacgcgaagaaccttacctggccttgacatactagaaactttccagagatggattggtgccttcgggaatttagatacaggtgctgcatggctgtcgtcagctcgtgttgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggatgctacacagcgaggtcatgctaatctcaaaaagccgatcgtagtccggattggagtctgcaactcgactccatgaagtcggaatcgctagtaatcgcggatcagaatgccgcggtgaatacgtt

SEQ ID NO: 42 - DNA, 1540 bp, Acinetobacter sp. RUH2624
tttaactgaagagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 43 - DNA, 1540 bp, Acinetobacter sp. SH024
tttaactgaagagtttgatcatggctcagattgaacgctggcggcaggcttaacacatgcaagtcgagcggagagaggtagcttgctactgatcttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagtcgtaacaaggtagccgtaggggaacctgcggctggatcacctcctta

SEQ ID NO: 44 - DNA, 1362 bp, Actinobacillus actinomycetemcomitans
attgaacgctggcggcaggcttaacacatgcaagtcggacggtagcaggagaaagcttgctttcttgctgacgagtggcggacgggtgagtaatgcttggggatctgtcttatggagggggataacgacgggaaactgtcgctaataccgcgtagagtcgggagacgaaagtgcgggaccttagggccgcatgccatgagatgagcccaagtgtgattaggtagttggtggggtaaaggcctaccaagccgacgatcgctagctggtctgagaggatggccagccacaccgggactgagacacggcccggactcctacgggaggcagcagtggggaatattgcgcaatgggggcaaccctgacgcagccatgccgcgtgaatgaagaaggccttcgggttgtaaagttctttcggtgatgaggaaggttggtgtgttaatagcatgccaacttgacgttaaatacagaagaagcaccggctaactccgtgccagcagccgcggtaatacggggggtgctagcgttaatcggaataactgggcgtaaagggcacgtaggcggacctttaagtgaggtgtgaaatccccgggcttaacctgggaattgcatttcatactgggggtctggagtactttagggaggggtagaattccacgtgtagcggtgaaatgcgtagagatgtggaggaataccgaaggcgaaggcagccccttggggatgtactgacgctgatgtgcgaaagcgtggggagcaaacaggattagataccctggtagtccacgctgtaaacggtgtcgatttggggattggggtttagccctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccgaagaagaactcagagatgggtttgtgccttagggagctttgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggtaaccaaccagcgatggggagtgaatctcagaaagtgcgtctaagttcggattggagtctgcaactcgactccatgaagtcggaatcgctagtaatcgcgaatcagaatgttgcggtgaatacgttcccgggcctt

SEQ ID NO: 45 - DNA, 1542 bp, Actinobacillus minor
gaattgaagagtttgatcatggctcagattgaacgctggcggcaggcttaacacatgcaagtcgaacggtaacagggagaaagcttgctttctttgctgacgagtggcggacgggtgagtaatgcttgggaatctggcttatggagggggataactacgggaaactgtagctaataccgcgtaatatcttcggattaaagggtgggaccgtaaggccacctgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaaggcaggtaagttaatagcttacttgattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgggcttaacctgggaattgcatttcatactgggtcgctagagtattttagggaggggtagaattccacgtgtagcggtgaaatgcgtagagatgtggaggaataccgaaggcgaaggcagccccttgggaatatactgacgctcatgtgcgaaagcgtggggagcaaacaggattagataccctggtagtccacgctgtaaacgctgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccaaagaagaactcagagatgagtttgtgccttcgggaactttgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaacggaaacgggggcgtttaccacggtatgattcatgactggggtgaagtcgtaacaaggtaaccgtaggggaacctgcggttggatcacctcctta

SEQ ID NO: 46 - DNA, 1538 bp, Actinobacillus pleuropneumoniae
gaattgaagagtttgatcatggctcagattgaacgctggcggcaggcttaacacatgcaagtcgaacggtaacgggaagggagcttgctttctttgccgacgagtggcggacgggtgagtaatgcttgggaatctggcttatggagggggataactacgggaaactgtagctaataccgcgtaatatctatggattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatgggggggaacctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggtgtgattaagtgagatgtgaaagccccgggcttaacctgggattgcattacatactggtcaactagagtactttagggagggggagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactgtgagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcaagatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcggttggatcacctc

SEQ ID NO: 47 - DNA, 1536 bp, Actinobacillus succinogenes
agagtttgatcatggctcagattgaacgctggcggcaggcttaacacatgcaagtcgaacggtaacgggtggaaagcttgctttccatgctgacgagtggcggacgggtgagtaatgcttggggatctggcttatggagggggataacgacgggaaactgtcgctaataccgcgtaatgtctaaggactaaagggtgggattttcggaccgcccgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcgcaatgggggcaaccctgacgcagccatgccgcgtgaatgaagaaggccttcgggttgtaaagttctttcggtggtgaggaaggcgaataagttaacagcttattcgattgacgttagccacagaagaagcaccggctaactccgtgccagcagccgcggtaatacggagggtgcgagcgttaatcggaataactgggcgtaaagggcacgcaggcggctatttaagtgagatgtgaaatccccgggcttaacctgggaactgcatttcagactgggtagctagagtactttagggaggggtagaattccacgtgtagcggtgaaatgcgtagagatgtggaggaataccgaaggcgaaggcagccccttgggaacgtactgacgctcatgtgcgaaagcgtggggagcaaacaggattagataccctggtagtccacgctgtaaacgctgtcgatttggggattgggcgataagcctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctcagaatccggtagagatatcggagtgccttcgggaactgagagacaggtgctgcatggctgtcgtcagctcgtgttgtgaaatgttgggttaagtcccgcaacgagcgcaacccttatcctttgttgccagcatgtagagatgggaactcaaaggagactgccggtgataaaccggaggaaggtggggatgacgtcaagtcatcatggcccttacgagtagggctacacacgtgctacaatggcgtatacagagggaaacgagcctgcgagggggagtgaatctcagaaagtgcgtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgtaccagaagtagatagcttaaccgaaagggggggcgtttaccacggtatgattcatgactggggtgaagtcgtaacaaggtaaccgtaggggaacctgcggttggatcacctcctt

SEQ ID NO: 48 - DNA, 1543 bp, Actinobacillus ureae
ttgaattgaagagtttgatcatggctcagattgaacgctggcggcaggcttaacacatgcaagtcgaacggtaacagggattagcttgctaatttgctgacgagtggcggacgggtgagtaatgcttgggaatttggctcatggagggggataactacgggaaactgtagctaataccgcgtaatatcttaggattaaagtgtgggaccgcaaggccacatgccatgagatgagcccaagtgggattaggtagttggtggggtaaaggcctaccaagccgacgatctctagctggtctgagaggatgatcagccacactggaactgagacacggtccagactcctacgggaggcagcagtggggaatattgcacaatgggggggaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccctgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggttggatcacctccttac

SEQ ID NO: 49 - DNA, 1500 bp, Actinobaculum massiliae
agtttgatcctggctcaggacgaacgctggcggcgtgcttaacacatgcaagtcgaacggaaaggcccttccttttttggttgggtgctcgagtggcgaacgggtgagtattacgtgagtaacctgccctcaactgtgggataagcctgggaaactgggtctaatactgcatattcttctttcaccgcatggtgggggttggaaagttttttcggttggggatgggctcgcggcctatcagcttgttggtggggtgatggcctaccaaggcggtgacgggtagccggcctgagagggtggtcggccacattgggactgagatacggcccagactcctacgggaggcagcagtgggggatattgcacaatgggcgcaagcctgatgcagcgacgccgcgtgagggatgaaggctttcgggttgtaaacctctttcggtacagaacaaggcacgttttttgcgtgtggagggtatgtgcagaagaagcgccggctaactacgtgccagcagccgcggtaatacgtagggcgcgagcgttgtccggaattattgggcgtaaagggctcgtaggcggcttgttgcgcctgctgtgaaaacgcggggcttaactccgcgcgtgcagtgggtacgggcaggcttgagtgtggtaggggtgactggaattccrggtgtagcggtggaatgcgcagatatctggaggaacaccgatggcgaaggcaggtcactgggccattactgacgctgaggagcgaaagcgtgggtagcgaacaggattagataccctggtagtccacgctgtaaacgttgggaactaggtgtggggcccttttccggggttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccgggagcatgcagagatgtgtgtgcctttttggctggtgtacaggtggtgcatggttgtcgtcagctcgtgtcgtgagatgttgggttaagtcccgcaacgagcgcaacccttgtctcgtgttgccagcgcgttatggtggggactcacgagagactgccggggttaactcggaggaaggtggggatgacgtcaaatcatcatgccccttatgtcttgggcttcacgcatgctacaatggccggtacagtgggttgcgatactgtgaggtggagcgaatctctgaaagccggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggcaacacccgaagcccgtggcctaaccttttggggggagcggtcgaaggtggggttggcgattgggacgaagtcgtaacaaggtagccgta

SEQ ID NO: 50 - DNA, 1487 bp, Actinobaculum schaalii
ggttcaggacgaacgctggcggcgtgcttaacacatgcaagtcgaacgatgaaacctagcaatctttggttgttgggtggattagtggcgaacgggtgagtaatacgtgggtaacctgccctcctttttgggataagccttggaaacggggtctaataccgaatattctggatgattcgcatggattgtttgggaaagcttttgtgaagggggatgggctcgcggcctatcagcttgttggtggggtgatggcctaccaaggcggtgacgggtagccggcctgagagggtgaccggccacattgggactgagatacggcccagactcctacgggaggcagcagtgggggatattgcacaatgggcgaaagcctgatgcagcgacgccgcgtgggggatgaaggctttcgggttgtaaacctctttcgctatcgaacaaggctcactatagggtgggttgagggtaggtggagaagaagcgccggctaactacgtgccagcagccgcggtaatacgtagggcgcgagcgttgtccggaattattgggcgtaaagggcttgtaggcggcttgttgcgcctgctgtgaaaacgcggggcttaacttcgcgcgtgcagtgggtacgggcaggcttgagtgtggtaggggtgactggaattccaggtgtagcggtggaatgcgcagatatctggaggaacaccgatggcgaaggcaggtcactgggccattactgacgctgaggagcgaaagcatgggtagcgaacaggattagataccctggtagtccatgctgtaaacgttgggaactaggtgtggggggcctttccaggttttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccgcggggctgcagagatgtggttgcatttggttggtggtgtacaggtggtgcatggttgtcgtcagctcgtgtcgtgagatgttgggttaagtcccgcaacgagcgcaacccttgtctcgtgttgccagcatgttgtggtggggactcacgagagactgccggggttaactcggaggaaggtggggatgacgtcaaatcatcatgccccttatgtcttgggcttcacgcatgctacaatggccggtacagagggttgcgatatcgtaaggtggagckaatcccttaaagctggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggtaacacccgtagctcgtggcctaaccattttatgtggggggagcggtcgaaggtggggctggcgattgggacgaagtcgtaa

SEQ ID NO: 51 - DNA, 1283 bp, Actinobaculum sp. BM#101342
atggaaacggggtctaatactggatattcctgtctggtcgcatggctgggtggggaaagttttttcggtgggggatgggctcgcggcctatcagcttgttggtggggtgatggcctaccaaggcgtcgacgggtagccggcctgagagggtgaccggccacactgggactgagatacggcccagactcctacgggaggcagcagtgggggatattgcacaatgggcgcaagcctgatgcagcgacgccgcgtgggggatgacggctttcgggttgtaaacctctttcgtcgggggacaaggctctgcttggtggtggggttgagggtacccggtgaagaagcgccggctaactacgtgccagcagccgcggtaatacgtagggcgcgagcgttgtccggaattattgggcgtaaagggctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgttactgacgctgaggagcgaaagcgtggggagcgaacaggattagataccctggtagtccatgctgtaaacgttgggaactaggtgtggggttctttccacggattctgcgccggagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacgctgggacggtgcagagatgtgctggcttttgctggtgtacaggtggtgcatggttgtcgtcagctcgtgtcgtgagatgttgggttaagtcccgcaacgagcgcaacccttgtctcgtgttgccagcaggttgggctggggactcacgggagactgccggggttaactcggaggaaggtggggatgacgtcaaatcatcatgccccttatgtcttgggcttcacgcatgctacaatggccggtacagagggttgcgatatcgtgaggtggagcgaatcccttaaagtcggtctcagttcggatcggggtctgcaactcgaccccgtgaagtcggagtcgctagtaatcgcggatcagcaacgccgcggtgaatacgttctcgggccttgtacacaccgcccgtcacgtcacgaaagttggcaacacccgaagctcgtggc

SEQ ID NO: 52 - DNA, 1313 bp, Actinobaculum sp. P2P_19 P1
gacgaacgctggcggcgtgcttaacacatgcaagtcgaacgagtggcgaacgggtgagtaatacgtgagtaacctgccctcttctttgggataagccttggaaacggggtctaatactggatattgaaagcggtgggggatgggctcgcggcctatcagcttgttggtggggtgatggcctaccaaggcgtcgacgggtagccggcctgagagggtgaccggccacactgggactgagatacggcccagactcctacgggaggcagcagtgggggatattgcacaatgggcgcaagcctgatgcagcgacgccgcgtgggggatgacggctttcgggttgtaaacctctttcgtcgggggacatgagggtacccggtgaagaagcgccggctaactacgtgccagcagccgcggtaatacgtagggcgcgagcgttgtccggaattattgggcgtaaagggctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgactgacgctgaggagcgaaagcgtggggagcgaacaggattagataccctggtagtccatgctgtaaacgttgggaactaggtgtggggtattctgcgccggagctaacgcattaagttccccgcctggggagtacggccgcaaggctaaaactcaaagggattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaacccttgtctcgtgttgccagcagctggggactcacgggagactgccggggttaactcggaggaaggtggggatgacgtcaaatcatcatgccccttatgtcttgggcttcacgcatgctacaatggccggcagagggttgcgatatcgtgaggtggagcgaatccctttcggtctcagttcggacggggtctgcaactcgaccccggaagtcggagtcgctagtaatcgcggatcagcaacgccgcggtgaatacgttctcgggccttgtacacaccgcccgtcacgtcacgaaagttggcaacacccgaagctcgtgcctagggagcggtcgaaggtggggttggcgattgggacgaagtcgtaacaaggta

SEQ ID NO: 53 - DNA, 1526 bp, Actinomyces cardiffensis
gagtttgatcctggctcaggacgaacgctggcggcgtgcttaacacatgcaagtcgaacgatgatgcggtgcgtgcaccgttgattagtggcgaacgggtgagtaacacgtgagtaacctgccctcttctttgggataacggtctgaaagggctgctaatactgaatattcacatgtcttcgcatgggggtgtgtggaaagagatgcttttgggtgtttttggtgggggatgggctcgcggcctatcagcttgttggtggggtagtggcctaccaaggctttgacgggtaaccggcctgagagggtgaccggtcacattgggactgagatacggcccagactcctacgggaggcagcagtggggaattttgcacaatggacgcaagtctgatgcagcgacgccgcgtgagggatgtaggccttcgggttgtgaacctctttcgctcatggtcaagccgcagctttgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgacgctgcagagatgtggtggcatttggttgggggtgtacaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgtcgtaaggcggagcgaatcccttaaagctggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccggtttgtctggggggagtggtcgaaggtgggattggcgattgggacgaagtcgtaacaaggtagccgtaccggaaggtgc

SEQ ID NO: 54 - DNA, 1410 bp, Actinomyces europaeus
  modified_base (318)..(318): a, c, t, g, unknown or other
  modified_base (325)..(325): a, c, t, g, unknown or other
cctggctcaggacgaacgctggcggcgtgcttaacacatgcaagtcgaacgggatccaaaggctttttgtttttggtgagagtggcgaacgggtgagtaacacgtgagtaacctgcccccttcttttggataaccgcatgaaagtgtggctaatacaggatattccaggctggtcgcatgattggtttgggaaatggtttggtctggtgggggatgggctcgcggcctatcagcttgttggtggggtgatggcctaccaaggcggtgacgggtagccggcctgagagggtgggcggtcacactgggactgagatacgncccagantcctacgggaggcagcagtgggggattttgcacaatgggcgcaagcctgatgcagcgacgccgcgtgagggatgaaggccttcgggttgtaaacctctttcgctgggttgaaaggccatgctttgggtgtggttgatttgaactggtaaagaagtaccggctaactacgtgccagcagccgcggtaatacgtagggtactagcgttgtccggatttattgggcgtaaagggcttgtaggtggtttgtcgcgtctgtcgtgaaatcctgtggcttaaccatgggcttgcggtgggtacgggcaggcttgagtgcggtaggggagactggaattcctggtgtagcggtggaatgcgcagatatcaggaggaacaccggtggcgaaggcgggtctctgggccgttactgacactgaggagcgaaagcgtggggagcgaacaggattagataccctggtagtccatgctgtaaacgttgggcactaggtgtgggggccgtgtggtttctgcgccgtagctaacgcattaagtgtcccgcctggggagtacggccgcaaggctaaaactcaaaggaattgacggggacccgcacaagcggcggagcatgcggattaattcgatgcaacgcgaagaaccttaccaaggcttgacatgcaccggtacagtgtagagatatgctggcctttttggctggtgtgcaggtggtgcatggttgtcgtcagctcgtgtcgtgagatgttgggttaagtcccgcaacgagcgcaacccttgtctcgtgttgccagcatttggttggggactctcgagagactgccggggttaactcggaggaaggtggggatgacgtcaaatcatcatgccccttatgtcttgggcttcacgcatgctacaatggatggtacagagggttgcgatactgtgaggtggagctaatcccttaaagctgttctcagttcggatcgtagtctgcaactcgactacgtgaaggtggagtcgctagtaatcgcagatcagcaacgctgcggtgaatacgttctcgggtcttgtacacaccgcccgtcacgtcacgaaagttggtaacacccgaa

SEQ ID NO: 55 - DNA, 1503 bp, Actinomyces funkei
atcatggctcaggacgaacgctggcggcgtgcttaacacatgcaagtcgaacggactggccttgagcttgcttggggttggtgagtggcgaacgggtgagtaacacgtgagtaacctgccctcttctttgggataacggtcggaaacggctgctaatactggatattcactcattggcgcatgttggtgggtggaaagatgcacttttggtgtttttggtgggggatgggctcgcggcctatcagcttgttggtggggtgatggcctaccaaggctttgacgggtaaccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcgactttgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggtcgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcatcctgagccttcagagatggaggtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgctgtgaggcggagcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccgcctttttggtggggggagtggtcgaaggtgggattggcgattgggacgaagtcgtaacaa

SEQ ID NO: 56 - DNA, 1326 bp, Actinomyces genomosp. C1
gacgaacgctggcggcgtgcttaacacatgcaagtcgaacgagtggcgaacgggtgagtatcacgtgagtaacctgcccttcggtcctggataaccgcttgaaagggcggctaatacggggtggtgatagtcggcgggggatgggctcgcggcctatcagcttgttggtggggtgatggcctaccaaggcggtgacgggtagccggcctgagagggtgggcggccacactgggactgagatacggcccagactcctgcgggaggcagcagtggggggtattgcacaatgggcggaagcctgatgcagcgacgtcgcgtgagggatggaggccttcgggttgtgaacctctgtttccggtggtgatgacggtagccggggatgaagcgccggctaactacgtgccagcagccgcggtaatacgtagggcgcgagcgttgtccggaattattgggcgtaaagggcttgtaggcggctggtcgcgtctgccgtgaaattctccggctcaaccgggggcttgcggtgggtacgggccagctggagtgcggtaggggaggctggaactcctggtgtagcggtggaatgcgcagatatcaggaggaacaccggtggcgaaggcgggtctctgggccgactgacgctgaggagcgaaagcgtggggagcgaacaggattagataccctggtagtccacgccgtaaacgttgggcactaggtgtgggccggtccgcgccgcagctaacgcattaagtgccccgcctggggagtacggccgcaaggctaaaactcaaaggaattgacgggggcccgcacaagcgacggagcatgcggattaattcgatgcaacgcgaagaaccttaccagggcttgacatgtgcaggtggtgcatggttgtcgtcagctcgtgtcgtgagatgttgggttaagtcccgcaacgagcgcaacccctgtcccgtgttgccagcgcgcggggactctcgggagactgccggggtcaactcggaggagggtggggacgacgtcaaatcatcatgcccctgacgtcctgggcttcacgcatgctacaatggccggcagagggttgcgatgccgtgaggcggggcgaatcccttccggtctcagttcggacggtgtctgcaactcgacaccggaagtcggagtcgctagtaatcgcagatcagcattgctgcggtgaatacgttctcgggccttgtacacaccgcccgtcacgtcatgaaagtcggtgacgcccgaagcccgtgcgagcggtcgaaggcggggccggtgattgggacgaagtcgtaacaaggtagccgtaccggaaggtgc

SEQ ID NO: 57 - DNA, 1331 bp, Actinomyces genomosp. C2
gacgaacgctggcggcgtgcttaacacatgyaagtcgaacgagtggcgaacgggtgagtaacacgtgagtaacctgcccccttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctagggagtggtcgaaggtgggattggcgattgggacgaagtcgtaacaaggtagccgtaccggaaggtgc

SEQ ID NO: 58 - DNA, 1290 bp, Actinomyces genomosp. P1 oral clone MB6_C03
gacgaacgctggcggcgtgcttaacacatgcaagtcgaacgagtggcgaacgggtgagtatcacgtgagtaacctgccctcctctcctggataaccgcttgagagggcggctaatacggggtggtgatagtcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctgttcccggtggtgatgacggtagccgggtatgaagcgccggctaactacgtgccagcagccgcggtaatacgtagggcccaagcgttgtccggaattattgggcgtaaagggcttgtaggcggccggccgcgtccgtcgtgaaatcctccggctcaaccgggggcttgcggtgggtacgggtcggctggagtgcggcaggggaggctggaactcctggtgtagcggtggaatgcgcagatatcaggaggaacaccggtggcgaaggcgggtctctgggccgactgacgctgaggagcgaaagcgtggggagcgaacaggattagataccctggtagtccacgccgtaaacgttgggcactaggtgtggggcgctccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgcgcaggtggtgcatggttgtcgtcagctcgtgtcgtgagatgttgggttaagtcccgcaacgagcgcaacccctgtcccgtgttgccagcgcgcggggactctcgggagactgccggggtcaactcggaggagggtggggacgacgtcaaatcatcatgcccctgacgtcctgggcttcacgcatgctacaatggccggcagagggttgcgatgccgcgaggcggggcgaatcccttccggtctcagttcggacggtgtctgcaactcgacaccggaagtcggagtcgccagtaatcgcagatcagcactgctgcggtgaatacgttctcgggccttgtacacaccgcccgtcacgtcatgaaagtcggcgacgcccgaagcccgtgcgagcggtcgaaggcggggccggtgattggg

SEQ ID NO: 59 - DNA, 1427 bp, Actinomyces georgiae
acacatgcagtcgaacgctgaagcctggctttgtgttgggtggatgagtggcgaacgggtgagtaacacgtgagtaacctgccctcttcttcgggataacggtctgaaagggctgctaataccgggtattcactggtcctcgcatgggggttggtggaaaggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcggaagcctgatgcagcgacgccgcgtgagggatggaggccttcgggttgtgaacctctttcgcccgtggtcaagccgcaactgtgggttgtggtgagggtagtgggtaaagaagcgccggctaactacgtgccagcagccgcggtaatacgtagggcgcgagcgttgtccgggaattattgggcgtaaagggcttgtaggcggctggtcgcgtctgccgtgaaatcctctggctcaactgggggcgtgcggtgggtacgggctggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttatggcggggactcgtgggggactgccggggttaactcggaggaaggtggggatgacgtcaaatcatcatgccccttatgtcttgggcttcacgcatgctacaatggctggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgg

SEQ ID NO: 60 - DNA, 1446 bp, Actinomyces israelii
cgtgcttaacacatgcaagtcgaacgggtctgccttgttttttgcggggtgggtcagtggcgaacgggtgagtaacacgtgagtaacctgcccctcacttctggataaccgcttgaaagggtggctaatacggggtgttctggctgtgccgcatggtgtggctgggaaagattcacttttgtggtgttttggtgggggatgggctcgcggcctatcagcttgttggtggggtgatggcctgccaaggctttgacgggtagccggcctgagagggtgggcggtcacactgggactgagatacggcccagactcctgcgggaggcagcagtggggggtattgcacaatgggcggaagcctgatgcagcgacgtcgcgtgagggatggaggccttcgggttgtgaacctctttcgccggtgaagaaggtcctgttctttgtggtggggctgacggtagccgggttatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtggggggtctttccgggtcctccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccagggcttgacatgggccggctgctcctggagacgggggcctcccttttttgggccggttcacaggtggtgcatggttgtcgtcagctcgtgtcgtgagatgttgggttaagtcccgcaacgagcgcaacccctgtcccgtgttgccagcgtgttgtggcggggactcgcgggagactgccggggttaactcggaggagggtggggacgacgtcaaatcatcatgccccttatgtcctgggcttcacgcatgctacaatggccggtacagtgggttgcgatgtcgtgaggcggagcgaatcccttaaagccggtctcagttcggatcggtgtctgcaactcgacaccgtgaagctggagtcgctagtaatcgcagatcagcagtgctgcggtgaatacgttctcgggccttgtacacaccgcccgtcacgtcatgaaagccggcgacacccgaagcccgtggccctgtggggagcggtcgaaggtggggct

SEQ ID NO: 61 - DNA, 1520 bp, Actinomyces massiliensis
agagtttgatcctggctcaggacgaacgctggcggcgtgcttaacacatgcaagtcgaacgggccttgtccccttttttttgggggtggggttagtggcgaacgggtgagtaacacgtgagtaacctgcccctcacttctggataaccgcttgaaagggtggctaatacggggtgttctggcctgctcgcatgggtgggtttggaaagattcgaccggttttggttgttttggtgggggatgggctcgcggcctatcagcttgttggtggggtgatggcctgccaaggctttgacgggtagccggcctgagagggtgggcggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtggggttgacggtagctgggttaatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggagactggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggctggattgcttcggagacggggtttcccttttttgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggttaactcggaggaaggtggggatgacgtcaaatcatcatgccccttatgtcttgggcttcacgcatgctacaatggccggtacagtgggttgcgatgctgtgaggcggagcgaatccctgaaagccggtctcagttcggatcggtgtctgcaactcgacaccgtgaagttggagtcgctagtaatcgcagatcagcagcgctgcggtgaatacgttctcgggccttgtacacaccgcccgtcacgtcatgaaagctggcaacacccgaagcccgtggccttatggggagcggtcgaaggtggggctggtgattgggacgaagtcgtaacaaggtaacc

SEQ ID NO: 62 - DNA, 1411 bp, Actinomyces meyeri
attgccaagttcgaaacgctgaagcctagcttgctgggtggatgagtggcgaacgggtgagtaacacgtgagtaacctgccctcttctttgggataacgcccggaaatgggtgctaatactggatattcactggtcttcgcatgggggttggtggaaagggtttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcaagccgcaactgtgggttgtggtgagggtagtgggtaaagaagcgccggctaactacgtgccagcagccgcggtatacgtaggcgcgagcgttgtccgaattattgggcgtaaagggcttgtaggcggttggtcgcgtctgtcgtgaaatcctctggcttaactgggggcgtgcggtgggtacgggctggcttgagtgcggtaggagagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgggcgtgcggagacgtgcgtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttttgctggggggggaag

SEQ ID NO: 63 - DNA, 1450 bp, Actinomyces naeslundii
tcctgactcaggacgaacgctgccggcgtacataacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgggtctgtcgcatggtgggcctgggaaagattgcgccttttttggtgtttttggtgggggatgggctcgcggcctatcagcttgttggtggggtgatggcctgccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgcctcgtttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtctgctccggagacggggtttcctcctttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgt

SEQ ID NO: 64 - DNA, 1328 bp, Actinomyces nasicola
gacgaacgctggcggcgtgcttaacacatgcaagtcgaacgagtggcgaacgggtgagtaacacgtgagtaacctgcccccttctttgggataactgccggaaacggtggctaatactggatattgaaagctggtgggggatgggctcgcggcctatcagcttgttggtggggtgatggcctaccaaggctttgacgggtagccggcctgagagggtgaccggccacactgggactgagacacggcccagactcctacgggaggcagcagtggggaatattgcacaatgggggaaaccctgatgcagcgacgccgcgtgagggatgacggccttcgggttgtaaacctctttcagtagggaagaagacggtacctgcagaagaagcgccggctaactacgtgccagcagccgcggtaatacgtagggcgcaagcgttgtccggaattattgggcgtaaagagctcgtaggcggcttgtcgcgtctgtcgtgaaaacctgcagcttaactgtgggcttgcggtgggtacgggctggcttgagtgcagtaggggagactggaattcctggtgtagcggtggaatgcgcagatatcaggaggaacaccggtggcgaaggcgggtctctgggctgactgacgctgaggagcgaaagcatggggagcgaacaggattagataccctggtagtccatgccgtaaacgttgggcactaggtgtggggatttctgtgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaacccttgtctcatgttgccagcacgtggggactcatgagagactgccggggttaactcggaggaaggtggggatgacgtcaaatcatcatgccccttatgtcttgggcttcacgcatgctacaatggccggcagtgggttgcgatctcgtgagggggagctaatccttgccggtctcagttcggatggggtctgcaactcgaccccagaagtcggagtcgctagtaatcgcagatcagcaacgctgcggtgaatacgttctcgggccttgtacacaccgcccgtcacgtcacgaaagttggtaacacccgaagctcatgcctagggagtggtcgaaggtgggactggcgattgggacgaagtcgtaacaaggtagccgtaccggaagg

SEQ ID NO: 65 - DNA, 1489 bp, Actinomyces neuii
  modified_base (159)..(159): a, c, t, g, unknown or other
cgaacgctggcggcgtgcttaacacatgcaagtcgaacgggatccattagcgcttttgtgtttttggtgagagtggcgaacgggtgagtaacacgtgagtaacctgcccttttctttgggataagcctgggaaactgggtctaatactggatgttccgncttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacggaagtctgatgcaccgacgtcgtgtgggggatgaaggccttcgggttgtaaactcctttcgcccgcggaaaaggcagggttttggccttgttgatggtagtgggtaaagaagcgccggctcactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttggttaagtcccgcaacgagcgcaacccttgtctcatgttgccagcacgttatggtggggactcgtgagagactgccggggttaactcggaggaaggtggggatgacgtcaaatcatgatgccccatatgtcttgggcttcacgcatgctacagtggtgtctacagagggttgctattccgtgaggttgagcgaatctcttaaagggcatcttggttcggatcgcagtctgcaactcgactgcgtgaaggtggagtcgctagtaatcgcagatgagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaagg

SEQ ID NO: 66 - DNA, 1548 bp, Actinomyces odontolyticus
tttgttcggagagtttgatcctggctcaggacgaacgctggcggcgtgcttaacacatgcaagtcgaacgctgaagcctagcttgctgggtggatgagtggcgaacgggtgagtaacacgtgagtaacctgcccccttctttgggataacgcccggaaacgggtgctaatactggatattcactggtcttcgcatgggggttggtggaaaggtttgttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacattggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgaaatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgctttgtgtggggggagtggtcgaaggtgggattggcgattgggacgaagtcgtaacaaggtagccgtaccggaaggtgcggctggatcacctcctttctaggg

SEQ ID NO: 67 - DNA, 1508 bp, Actinomyces oricola
  modified_base (32)..(32): a, c, t, g, unknown or other
gacgaacgctggcggcgtgcttaacacatgcnagtcgaacgggccggccccttgttttttggggggttggttgagtggcgaacgggtgagtaacacgtgagtaacctgccctcttcttctggataaccgcatgaaagtgtggctaatacgggatattctggtctgcctgcatgggtgggttgggaaagattcactttggtgttttggtgggggatgggctcgcggcctatcagcttgttggtggggtgatggcctaccaaggcggtgacgggtagccggcctgagagggtgggcggtcacactgggactgagatacggcccagactcctacgggaggcagcagtgggggatattgcacaatgggcggaagcctgatgcagcgacgtcgcgtgagggatggaggccttcgggttgtgaacctctttcgccagtgaagtaggtctgctcctgtgtgggtgggttgacggtagctgggtttttaagaagcgccggctaactacgtgccagcagccgcggtgatacgtagggcgcgagcgttgtccggaattattgggcgtaaagggcttgtaggcggctggtcgcgtctgccgtgaaatcctctggcttaactgggggtgtgcggtgggtacgggtcggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccatgctgtaaacgttgggcactaggtgtggggggcctttccgggttttccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgggctggtttggtctggagacaggccgtccctttttttggggctggttcacaggtggtgcatggttgtcgtcagctcgtgtcgtgagatgttgggttaagtcccgcaacgagcgcaacccttgtctcgtgttgccagcatgttgtggtggggactcgcgggagactgccggggttaactcggaggaaggtggggatgacgtcaaatcatcatgccccttatgtcttgggcttcacgcatgctacaatggccggtacagtgggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaagg

SEQ ID NO: 68 - DNA, 1517 bp, Actinomyces orihominis
tcaggacgaacgctggcggcgtgcttaacacatgcaagtcgaacgggcccgcccctgtttttgggggtgggttgagtggcgaacgggtgagtatcacgtgagtaacctgccccctgctcctggataactgcttgaaagggcggctaatacggggtgtgccggctggtccgcatgggcctggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctttctccggtggtgaaggccctgtccgttgcggcggggttgacggtagccgggtatgaagcgccggctaactacgtgccagcagccgcggtaatacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggccccgctcggcgggggtccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccagggcttgacatgggggcggcggcgccggagacggcgcctccctttttcgggcgcccccgcaggtggtgcatggttgtcgtcagctcgtgtcgtgagatgttgggttaagtcccgcaacgagcgcaacccctgtcccgtgttgccagcgcgtcgtggcggggactctcgggagactgccggggtcaactcggaggagggtggggacgacgtcaaatcatcatgcccctgacgtcctgggcttcacgcatgctacaatggccggtacagagggttgcgatgccgtgaggcggggcgaatcccttaaagccggtctcagttcggatcggtgtctgcaactcgacaccgtgaagtcggagtcgctagtaatcgcagatcagcattgctgcggtgaatacgttctcgggccttgtacacaccgcccgtcacgtcatgaaagtcggcgacgcccgaagcccgtggccccatggggagcggtcgaaggcggggccggtgattgggacgaagtcgtaacaaggtagccgtaccggaaggtgcggctgga

SEQ ID NO: 69 - DNA, 1535 bp, Actinomyces oris
agagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatgacgggtctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcccgcctcttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtgggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctg

SEQ ID NO: 70 - DNA, 1464 bp, Actinomyces sp. 7400942
gacgaacgctggcggcgtgcttaacacatgcaagtcgaacggtgaagctcctggcttttgttgggggtggatgagtggcgaacgggtgagtaacacgtgagtaacctgcccctttcttctggataccgccacgaaagtggtgttaatacgggatattctggcyctgtcgcatggkggggttgggaaaggtcttttctggtgggggatgggctcgcggcctatcagcttgttggtggggtgatggcctaccaaggcgttgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagcaggcccgctccttgtgggtgggttgacggtagctggataagaagcgccggctaactacgtgccagcagccgcggtaatacgtagggcgcgagcgttgtccggaattattgggcgtaaagggcttgtaggcggctggtcgcgtctgccgtgaaatcccctggcttaactgggggcgtgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggcctttccgggtcctccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtcggcgattcccgcggagacgcggtctccccctcgtggggcgccgtcacaggtggtgcatggttgtcgtcagctcgtgtcgtgagatgttgggttaagtcccgcaacgagcgcaacccctgtcccgtgttgccagcacgtcgtggtggggactcgcgggagactgccggggtcaactcggaggagggtggggatgacgtcaaatcatcatgccccttatgtcttgggcttcacgcatgctacaatggccggtacagagggttgcgatgccgcgaggcggggcgaatcccttaaagccggtctcagttcggatcggtgtctgcaactcgacaccgtgaagttggagtcgctagtaatcgcggatcagcaacgccgcggtgaatacgttctcgggccttgtacacaccgcccgtcacgtcatgaaagtcggcaacacccgaagcccgtggccccatggggagcggtcgaaggtggggccggtgattgggacg

SEQ ID NO: 71 - DNA, 1367 bp, Actinomyces sp. CCUG 37290
  modified_base (671)..(671): a, c, t, g, unknown or other
  modified_base (1259)..(1259): a, c, t, g, unknown or other
acgaacgctggcggcgtgcttaacacatgcaagtcgaacgctgaagacctggcttttgttgggttggatgagtggcgaacgggtgagtaacacgtgagtaacctgccctcttctttgggataacgcccggaaacgggtgctaatactggatattcactggccttcgcatgggggttggtggaaaggtttgttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaactgtgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcanatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttggttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatactgtgaggtggagcgaatcccttaaanccagtctcagttcggattggggtctgcaactcgaccccatgaaggtggagtcgctagtaatcgcagatcagcaacgctgcggtgaatacgttctcgggccttgtacac

SEQ ID NO: 72 - DNA, 1501 bp, Actinomyces sp. ChDC B197
agagtttgatcctggctcagacgaacgctggcggcgtgcttaacacatgcaagtcgaacggtgaagggaccagcttgctggttctggatgagtggcgaacgggtgagtaacacgtgagtaacctgcccccttcttctggataaccgcatgaaagtgtggctaatacgggatattctgggtctgtcgcatgacgggcccgggaaagatattgcttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactagtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggcttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagctggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtaacc

SEQ ID NO: 73 - DNA, 1274 bp, Actinomyces sp. GEJ15
  modified_base (398)..(400): a, c, t, g, unknown or other
  modified_base (450)..(450): a, c, t, g, unknown or other
taacctgccctcttcttctggataacctcatgaaagtggggctaatacggggtattccgggtctgtcgcatggcgggtttgggaaagattgcgcctttgggtgttttcggtgggggatgggctcgcggcctatcagcttgttggtggggtgatggcctaccaaggcggtgacgggtagccggcctgagagggtggacggccacactgggactgagacacggcccagactcctgcgggaggcagcagtggggaatattgcacaatgggcgcaagcctgatgcagcgacgccgcgtgagggatggaggccttcgggttgtgaacctctttcgccagtgaagcaggcctgctcgttgtcgtggtgacgtagctgatagagcgcgctactacgtgcagcagnnngtatacgtaggcgcgagcgtgtcagtaagtatgggcgtaaagagctcgtngcgctggtcgcgtctgtcgtgaaatcatctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttccctcctttgtgggggccggttcacaggtggtgcatggttgtcgtcagctcgtgtcgtgagatgttgggttaagtcccgcaacgagcgcaacccctgtcccgtgttgccagcacgttgtggtggggactcgcgggagactgccggggtcaactcggaggagggtggggatgacgtcaaatcatcatgccccttatgtcttgggcttcacgcatgctacaatggccggtacagagggctgcgatgccgtgaggtggagcgaatcccttaaagccggtctcagttcggatcggtgtctgcaactcgacaccgtgaagttggagtcgctagtaatcgcagatcagccaacgctgcggtgaatacgttcctcgggccttgtac

SEQ ID NO: 74 - DNA, 1320 bp, Actinomyces sp. HKU31
acggactgctcttcagcttgctggggggtggtgagtggcgaacgggtgagtaacacgtgagtaacctgccctcttctttgggataactgccggaaacggttgctaataccgggtattcactggtctccgcatgggggttggtggaaaggggcctcttttggggtttctggtgggggatgggctcgcggcttatcagcttgttggtggggtgatggcctaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtaaacctctttcgctcatggtcaagccgcaactgtggttgtggtgagggtagtgggtaaagaagcgccggctaactacgtgccagcagccgcggtaatacgtagggcgcgagcgttgtccggaattattgggcgtaaagggcttgtaggcggtttgtcgcgtctgccgtgaaattccctggcttaactgggggcgtgcggtgggtacgggcaggcttgagtgcggtaggggagactggaattcctggtgtagcggtggaatgcgcagatatcaggaggaacaccggtggcgaaggcgggtctctgggccgttactgacgctgaggagcgaaagcatggggagcgaacaggattagataccctggtagtccatgctgtaaacgttgggcactaggtgtggggaccgtccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgacactgcagagatgtggtggccttcggggtggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggtcggtacagagggttgcgataccgyraggtggagcgaatcccttaaagccggtctcagttcggattggggtctgcaactcgaccccatgaaggtggagtcgctagtaatcgcagatcagcaacgctgcggtgaatacg

SEQ ID NO: 75 - DNA, 1265 bp, Actinomyces sp. ICM34
acgaacgctggcggcgtgcttaacacatgcaagtcgaacgagtggcgaacgggtgagtaacacgtgagtaacctgccctcttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctaggg

SEQ ID NO: 76 - DNA, 1331 bp, Actinomyces sp. ICM41
tcttctttgggataacgcccggaaacgggtgctaatactggatattcactgatcttcgcatgggggttggtggaaaggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaacttagggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgcgtttgcggggggagtggt

SEQ ID NO: 77 - DNA, 1281 bp, Actinomyces sp. ICM47
gctcaggacgaacgctggcggcgtgcttaacacatgcaagtcgaacgagtggcgaacgggtgagtaacacgtgagtaacctgccctcttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaattctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgcctagggagtggtcga

SEQ ID NO: 78 - DNA, 1260 bp, Actinomyces sp. ICM54
gaacgctggcggcgtgcttaacacatgcaagtcgaacgagtggcgaacgggtgagtaacacgtgagtaacctgcccccttctttgggataacgcccggaaacgggtgctaatactggatattgaaagctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatgacggccttcgggttgtaaacctctttcgctcatggtcatgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgctgtaaacgttgggcactaggtgtgggggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtgcaggtggtgcatggttgtcgtcagctcgtgtcgtgagatgttgggttaagtcccgcaacgagcgcaacccttgccctatgttgccagcacgtggggactcgtgggggactgccggggttaactcggaggaaggtggggatgacgtcaaatcatcatgccccttatgtcttgggcttcacgcatgctacaatggttggcagagggttgcgatactgtgaggtggagcgaatcccttccagtctcagttcggatggggtctgcaactcgaccccagaaggtggagtcgctagtaatcgcagatcagcaacgctgcggtgaatacgttctcgggccttgtacacaccgcccgtcacgtcacgaaagttggtaacacccgaagcccatgccta

SEQ ID NO: 79 - DNA, 1484 bp, Actinomyces sp. M2231/94/1
  modified_base (770)..(770): a, c, t, g, unknown or other
  modified_base (772)..(772): a, c, t, g, unknown or other
  modified_base (878)..(878): a, c, t, g, unknown or other
  modified_base (939)..(939): a, c, t, g, unknown or other
ttgatcctggctcaggacgaacgctgacggcgtgcttaacacatgcaagtcgaacggtgaagcccctttttttggggtggatgagtggcgaacgggtgagtaacacgtgagtaacctgcccctgactcctggataactgcttgaaagggtggctaatacgggdgtgtcctggcctgggcgcatgtctgggtttggaaagattccatgtttttggttttggttggggatgggctcgcggcctatcagcttgttggtggggtgatggcctaccaaggcgttgacgggtagccggcctgagagggtggacggtcacactgggactgagacacggcccagactcctacgggaggcagcagtggggaatattgcacaatgggcgcaagcctgatgcagcgacgccgcgtgagggatgacggccttcgggttgtaaacctctttcgccagtgaggaaggcctgctcctttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgccgtgaaatcccctggcttaactgggggcgtgcggtgggtacgggccggcttgagtgcggtaggggaggctggaactcctggtgtagcggtggaatgcgcagatatcaggaggaacaccggtggcgaaggcgggtctctgggccgttactgacgctgaggagcgaaagcgtngngagcgaacaggattagataccctggtagtccacgccgtaaacgttgggcactaggtgtggggggtctttccgggtcctccgcgccgtagctaacgcattaagtgcnccgcctggggagtacggccgcaaggctaaaactcaaaggaattgacgggggcccgcacaancggcggagcatgcggattaattcgatgcaacgcgaagaaccttaccaaggcttgacatgtcagcgctggctgcagagatgtggtctcctcacttgtggggcgctgtcacaggtggtgcatggttgtcgtcagctcgtgtcgtgagatgttgggttaagtcccgcaacgagcgcaacccttgtcccgtgttgccagcacgtcgtggtggggactcgcgggagactgccggggtcaactcggaggaaggtggggatgacgtcaaatcatcatgccccttatgtcttgggcttcacgcatgctacaatggccggtacagagggctgcgatgccgtgaggcggagcgaatcccttaaagccggtctcagttcggatcggtgtctgcaactcgacaccgtgaagttggagtcgctagtaatcgcagatcagcaacgctgcggtgaatacgtcctcgggccttgtacacaccgcccgtcacgtcatgaaagctggcaacacccgaagcccgtggccctacggggagcggtcgaaggtggggctggtgattg

SEQ ID NO: 80 - DNA, 1419 bp, Actinomyces sp. TeJ5
  modified_base (500)..(500): a, c, t, g, unknown or other
  modified_base (503)..(503): a, c, t, g, unknown or other
gcttacacatgcagtcgaacgatgatgcggcgcttgcgccgttgattagtggcgaacgggtgagtaacacgtgagtaacctgcccccttcttcgggataacggtctgaaagggctgctaataccgggtattcactggtctccgcatgggggctggtggaaagggttttttctggtgggggatgggctcgcggcctatcagcttgttggtggggtgatggcccaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgcccgtggtcaagccgcgacgtgggtcgtggtgagggtagtgggtaaagaagcgccggctaactacgtgccagcagccgcggtaatacgtagggcgcgagcgtgtcnganatgggcgtaaagggctgtaggcgctggtcgcgtctgccgtgaaatcctctggctcaactgggagcgtgcggtgggtacgggctggcttgagtgcggtaggggaggctggaactctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttgtggcggggactcgtgggggactgccggggttaactcggaggaaggtggggatgacgtcaaatcatcatgccccttatgtcttgggcttcacgcatgctacaatggccggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgg

SEQ ID NO: 81 - DNA, 1443 bp, Actinomyces sp. c109
gccccacacatgcaagtggagcgacgaaccggggcttgccccggggcagagccgcgaacgggtgagtaacacgtgggttacctgccccgatgactgggacaacccgtcgaaagacgggctaataccggatgtgccccttgggggaaaggaagcttcggcctccgcatcgggatgggcccgcggcgcattagcttgttggtggggtaatggcttaccaaggcgacgatgcgtagctggtctgagaggacgatcagccacactgggactgagacacggcccagactcctacgggaggcagcagtggggaatcttgcacaatgcgcgaaagcgtgatgcagcaacgccgcgtgcgggaagaaggccctagggttgtaaaccgctttcagttgggacgaagcttcagtcgttaatagcggtttggagtgacggtaccttcagaagaagcgccggctaactacgtgccagcagccgcggtaatacgtagggcgcgagcgttgtccggaatcattgggcgtaaagcgcgtgtaggcggctgagtaagtctgctgtgaaagtccagggctcaaccctggaatgtcggcggatactgctcagctggagtacgggaggggcgagtggaattcctggtgtagcggtggaatgcgcagatatcaggaggaacacctatggcgaaggcagctcgctggaacgttactgacgctgagacgcgaaagcgtggggagcaaacaggattagataccctggtagtccacgctgtaaacgatggatactaggtgtggggggtgtcaactccctccgtgccgaagctaacgcattaagtatcccgcctggggagtacggccgcaaggctaaaactcaaaggaattgacgggggcccgcacaagcagcggagcatgtggtttaattcgacgcaacgcgaagaaccttacctgggcttgacatgttcttgatcggcgtggaaacacgtcttccctcacgggcaagatcacaggtggtgcatggctgtcgtcagctcgtgtcgtgagatgttgggttaagtcccgcaacgagcgcaacccccgtcgtatgttgccagcatttagttggggactcatgcgagactgccggtggcaaaccggaggaaggtggggatgacgtcaagtcatcatgccccttatgtccagggctacacacgtgctacattggcgtatacaaagggtagcgataccgcgaggtggagcgaatctcacaaagtacgtctcggttcggattgcaggctgaaactcgcctgcatgaaggtggagttgctagtaatcgtggatcagcaatgccgcggtgaatacgttcccgggccttgtacacaccgcccgtcacaccacgggagtgagcaacacccgaagccggtggcctaacccgcaagggagggagccgtcgaaggtggggctcgtgactggggtgaagtcg

SEQ ID NO: 82 - DNA, 1547 bp, Actinomyces sp. oral clone GU009
gagtttgattctggctcaggacgaacgctggcggcgtgcttaacacatgcaagtcgaacgggcccgcaccttttttgggggcgggttgagtggcgaacgggtgagtatcacgtgagtaacctgccctcctctcctggataaccgcttgaaagggcggctaatacggggtggtccggttggtccgcatgggccggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctgtttccggtggtgaaggccccgcccctggtggtggggttgacggtagccgggtatgaagcgccggctaactacgtgccagcagccgcggtaatacgtagggcgcgagcgttgtccggaattattgggcgtaaagggcttgtaggcggccggccgcgtccgtcgtgaaatcctccggctcaaccgggggcttgcggtgggtacgggtcggctggagtgcggcaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttgccggggggagtggtcgaaggtgggattggcgattgggacgaagtcgtaacaaggtagccgtaccggaaggtgcggctggaacacctccttc

SEQ ID NO: 83 - DNA, 1366 bp, Actinomyces sp. oral clone GU067
gagtttgatcctggctcaggacgaacgctggcggcgtgcttaacacatgcaagtcgaacgagtggcgaacgggtgagtaacacgtgagtaacctgcccccttcttctggataaccgcatgaaagtgtggctaatacgggatattgaaagtcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagctgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgactgacgctgaggagcgaaagcgtggggagcgaacaggattagataccctggtagtccacgccgtaaacgttgggcactaggtgtgggggcttccgcgccgtagctaacgcattaagtgccccgcccggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggttaactcggaggaaggtggggatgacgtcaaatcatcatgccccttatgtcttgggcttcacgcatgctacaatggccggcagtgggttgcgatgctgtgaggcggagcgaatccctgccggtctcagttcggacggtgtctgcaactcgacaccggaagttggagtcgctagtaatcgcagatcagcaacgctgcggtgaatacgttctcgggccttgtacacaccgcccgtcacgtcatgaaagctggcaacacccgaagcccgtgcctgggagcggtcgaaggtggggctggtgattgggacgaagtcgtaacaaggtagccgtaccggaaggtgcggctggaacacctcctt

SEQ ID NO: 84 - DNA, 1532 bp, Actinomyces sp. oral clone IO076
gagtttgattctggctcaggacgaacgctggcggcgtgcttaacacatgcaagtcgaacgatgaagcgctgtctttttggcggtgtggattagtggcgaacgggtgagtaatacgcgggcaacctgcccctctgcttcgggataagctttggaaacggggtctaataccggatgtgcctgtctggtcgcatggctgggcggggaaagatgtttttcggcgggggatgggctcgcggcctatcagcttgttggtggggtgacggcctaccaaggcgtcgacgggtagccggcctgagagggtggtcggccacactgggactgagatacggcccagactcctacgggaggcagcagtgggggatattgcacaatgggcgcaagcctgatgcagcgacgccgcgtgggggatggaggctttcgggttgtaaacccctttcggcgcgggacaaggctccgtttggcggggttgagggtacgcgtcaaagaagcgccggctaactacgtgccagcagccgcggtaatacgtagggcgcgagcgttgtccggaattattgggcgtaaagggctcgtaggcggcttgtcgcgtctgctgtgaaaacgcggggctcaactccgcgcgtgcagtgggtacgggcaggctggagtgcggcaggggtggctggaattcctggtgtagcggtggaatgcgcagatatcaggaagaacaccgatggcgaaggcaggccactgggccgtcactgacgctggggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggaacacctcctt

SEQ ID NO: 85 - DNA, 1544 bp, Actinomyces sp. oral clone IO077
gagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatggcgggtctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaattcctggtgtagcggtggaatgcgcagatatcaggaggaacaccggtggcgaaggcgggtctctgggccgtgtactgacgctgagagcgaaagcgtggggagcgaacaggattagataccctggtagtccatgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggtggttcccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccctgtacacaccgcccgtcacgtcatgaaagtcggcaacacccgaagcccgtggccttatggggagcggtcgaaggtggggctggtgattgggacgaagtcgtaacaaggtagccgtaccggaaggtgcggttggatcacctcctt

SEQ ID NO: 86 - DNA, 1362 bp, Actinomyces sp. oral clone IP073
gagtttgattctggctcaggacgaacgctggcggcgtgcttaacacatgcaagtcgaacgagtggcgaacgggtgagtaacacgtgagtaacctgccctcttctcttggataactgcttgaaagggcggctaatacgggatgttgaaagttggtgggggatgggctcgcggcttatcagcttgttggtggggtgatggcctaccaaggcggtgacgggtagccggcctgagagggtggacggtcacactgggactgagacacggcccagactcctgcgggaggcagcagtgggggattttgcacaatgggcgcaagcctgatgcagcgacgccgcgtgagggatggaggccttcgggttgtgaacctctgtcgccggtgatgttgacggtagccgggtatgaagtgccggctaactacgtgccagcagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaattcctggtgtagcggtggaatgcgcagatatcaggaggaacaccggtggcgaaggcgggtctctgggccgactgacgctgaggagcgaaagcgtggggagcgaacaggattagataccctggtagtccatgctgtaaacgttgggcactaggtgtgggggcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggtcaactcggaggagggtggggatgacgtcaaatcatcatgccccttatgtcttgggcttcacgcatgctacaatggccggcagagggctgcgataccgtgaggtggagcgaatcccttccggtctcagttcggacggtgtctgcaactcgacaccggaagttggagtcgctagtaatcgcagatcagcaacgctgcggtgaatacgttctcgggccttgtacacaccgcccgtcacgtcatgaaagtcggcaacacccgaagcccgtgcgagcggtcgaaggtggggctggtgattgggacgaagtcgtaacaaggtagccgtaccggaaggtgcggctggatcacctcctt

SEQ ID NO: 87 - DNA, 1543 bp, Actinomyces sp. oral clone IP081
gagtttgattctggctcaggacgaacgctggcggcgtgcttaacacatgcaagtcgaacgggcccgctctcttttttgggggtgggttgagtggcgaacgggtgagtatcacgtgagtaacctgccccctgctcctggataactgcttgaaagggcggctaatacggggtgtgccggctggtccgcatgggcctggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctttctccggtggtgaaggccctgtccgttgcggcggggttgacggtagccgggtatgaagcgccggctaactacgtgccagcagccgcggtaatacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggatcacctcctt

SEQ ID NO: 88 - DNA, 1366 bp, Actinomyces sp. oral clone JA063
gagtttgatcctggctcaggacgaacgctggcggcgtgcttaacacatgcaagtcgaacgagtggcgaacgggtgagtaacacgtgagtaacctgcccccttcttctggataaccgcatgaaagtgtggctaatacgggatattgaaagttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagctgacggtagctggataagaagcgccggctaactacgtgccagcagccgtggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgactgacgctgaggagcgaaagcgtggggagcgaacaggattagataccctggtagtccacgccgtaaacgttgggcactaggtgtgggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacaggtggtgcatggttgtcgtcagctcgtgtcgtgagatgttgggttaagtcccgcaacgagcgcaacccttgtctcgtgttgccagcacgtggggactcgcgggagactgccggggtcaactcggaggaaggtggggatgacgtcaaatcatcatgccccttatgtcttgggcttcacgcatgctacaatggccggcagagggctgcgataccgtgaggtggagcgaatcccttccggtctcagttcggacggtgtctgcaactcgacaccggaagttggagtcgctagtaatcgcagatcagcaacgctgcggtgaatacgttctcgggccttgtacacaccgcccgtcacgtcatgaaagtcggcaacacccgaagcccgtgcctgggagcggtcgaaggtggggctggtgattgggacgaagtcgtaacaaggtagccgtaccggaaggtgcggctggaacacctcctt

SEQ ID NO: 89 - DNA, 1563 bp, Actinomyces sp. oral taxon 170
tttgtttggagagtttgatcctggctcaggacgaacgctggcggcgtgcttaacacatgcaagtcgaacggtgaagcgccttcctttgtggtgggtgtggatgagtggcgaacgggtgagtaacacgtgagtaacctgcccccttcttctggataaccgcatgaaagtgtggctaatacgggatattctgtgcctgctgcatggtgggtgtgggaaagattgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtccctgtgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtttgcttcggagacggggtttcctcctttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctatggggagcggtcgaaggtggggctggtgattgggacgaagtcgtaacaaggtagccgtaccggaaggtgcggctggatcacctcctttct

SEQ ID NO: 90 - DNA, 1561 bp, Actinomyces sp. oral taxon 171
tttgtttggagagtttgatcctggctcaggacgaacgctggcggcgtgcttaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgtgcctgctgcatggtgggtgtgggaaagattgtgcctttgggtgttttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgtcccttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttct

SEQ ID NO: 91 - DNA, 1551 bp, Actinomyces sp. oral taxon 178
tttgttcggagagtttgatcctggctcaggacgaacgctggcggcgtgcttaacacatgcaagtcgaacgcgcctgtcctctggttttccggggggtgggtgagtggcgaacgggtgagtaacacgtgagtaacctgcccccttcttcgggataacggtctgaaagggctgctaataccgggtattcactggtctccgcatggggtctggtggaaaggttttttctggtgggggatgggctcgcggcctatcagcttgttggtggggtgatggcccaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgcccgtggtcaagccgcgacgtgggtcgtggtgagggtagtgggtaaagaagcgccggctaactacgtgccagcagccgcggtaatacgtagggcgcgagcgttgtccggaattattgggcgtaaagggcttgtaggcggctggtcgcgtctgccgtgaaatcctctggctcaactgggggcgtgcggtgggtacgggctggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttgtggcggggactcgtgggggactgccggggttaactcggaggaaggtggggatgacgtcaaatcatcatgccccttatgtcttgggcttcacgcatgctacaatggccggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacgcccgaagcccatggcccaaccggctcttgctggggggagtggtcgaaggtgggatcggcgattgggacgaagtcgtaacaaggtagccgtaccggaaggtgcggctggatcacctcctttct

SEQ ID NO: 92 - DNA, 1545 bp, Actinomyces sp. oral taxon 180
tttgttcggagagtttgatcctggctcaggacgaacgctggcggcgtgcttaacacatgcaagtcgaacgctgaagctcagcttttgttgggtggatgagtggcgaacgggtgagtaacacgtgagtaacctgcccccttctttgggataacgcccggaaacgggtgctaatactggatattcactggtcttcgcatgggggttggtggaaagggtttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcaagccgcaacaatggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatactgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccgcttttgcggggggagtggtcgaaggtgggattggcgattgggacgaagtcgtaacaaggtagccgtaccggaaggtgcggctggatcacctcctttct

SEQ ID NO: 93 - DNA, 1548 bp, Actinomyces sp. oral taxon 848
tttttgtggagagtttgatcctggctcaggacgaacgctggcggcgtgcttaacacatgcaagtcgaacgatgaagcgctgtctttttgatggtgtggattagtggcgaacgggtgagtaatacgcgggcaacctgcccctctgcttcgggataagctttggaaacggggtctaataccggatgtgcctgtctggtcgcatggctgggcggggaaagatgtttttcggcgggggatgggctcgcggcctatcagcttgttggtggggtgacggcctaccaaggcgtcgacgggtagccggcctgagagggtggtcggccacactgggactgagatacggcccagactcctacgggaggcagcagtgggggatattgcacaatgggcgcaagcctgatgcagcgacgccgcgtgggggatggaggctttcgggttgtaaacccctttcggcgcgggacaaggctccgtttggcggggttgagggtacgcgtcaaagaagcgccggctaactacgtgccagcagccgcggtaatacgtagggcgcgagcgttgtccggaattattgggcgtaaagggctcgtaggcggcttgtcgcgtctgctgtgaaaacgcggggctcaactccgcgcgtgcagtgggtacgggcaggctggagtgcggcaggggtggctggaattcctggtgtagcggtggaatgcgcagatatcaggaagaacaccgatggcgaaggcaggccactgggccgtcactgacgctgaggagcgaaagcgtggggagcgaacaggattagataccctggtagtccacgctgtaaacgttgggaactaggtgtggggtctgttccacggattctgcgccggagctaacgcgttaagttccccgcctggggagtacggccgcaaggctaaaactcaaaggaattgacgggggcccgcacaagcggcggagcatgcggattaattcgatgcaacgcgaagaaccttaccaaggcttgacatgtgccgggagggcgcggagacgcgtctgccttcgggccggttcacaggtggtgcatggttgtcgtcagctcgtgtcgtgagatgttgggttaagtcccgcaacgagcgcaacccttgtcccgtgttgccagcgcgttgtggcggggactcacgggggactgccggggtcaactcggaggaaggtggggacgacgtcaaatcatcatgccccttatgccttgggcttcacgcatgctacaatggccggtacagagggtggcgatgccgtgaggcggagcgaatcttgtaaagccggtctcagttcggatcggggtctgcaactcgggcccgtgaagtcggagtcgctagtaatcgcagatcagcaacgctgcggtgaatacgttctcgggccttgtacacaccgcccgtcacgtcacgaaagtcggcgacgcccgaagcccgtggctctgcttgtgcggggagcggtcgaaggcggggttggcgattgggacgaagtcgtaacaaggtagccgtaccggaaggtgcggctggatcacctcctttctagggag

SEQ ID NO: 94 - DNA, 1505 bp, Actinomyces sp. oral taxon C55
agagtttgatcctggctcaggacgaacgctggcggcgtgcttaacacatgcaagtcggacggactgcttgggggcttgctcctgggtggtgagtggcgaacgggtgagtaacacgtgagtaacctgccctcttcttcgggataacggttggaaacggctgctaataccgggtattcactggtcctcgcatgggggttggtggaaaggggtttttctggtgggggatgggctcgcggcttatcagcttgttggtggggtgatggcttaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcagttttgtctgtggtgagggtagtgggtaaagaagcgccggctaactacgtgccagcagccgcggtaatacgtagggcgcgagcgttgtccggaattattgggcgtaaagggcttgtaggcggcttgtcgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggaacgaaagcatggggagcgaacaggattagataccctggtagtccatgctgtaaacgttgggcactaggtgtgggggccgtccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgacactgcagagatgtggtggccttcggggtggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggcaggtacagagggttgcgatgccgtgaggtggagcgaatcccttaaagcttgtctcagttcggattggggtctgcaactcgaccccatgaaggtggagtcgctagtaatcgcagatcagcaacgctggggtgaatacgttctcgggccttgtacacaccgcccgtcacgtcacgaaagttggtaacacccgaagcccatggcccaaccatttcggtggggggagtggtcgaaggtgggattggcgattgggacgaagtcgtaacaaggtagccgt

SEQ ID NO: 95 - DNA, 1543 bp, Actinomyces urogenitalis
tttgtttggagagtttgatcctggctcaggacgaacgctggcggcgtgcttaacacatgcaagtcgaacggtgaagctccagcttgctggggtggatgagtggcgaacgggtgagtaacacgtgagtaacctgcccccttcttctggataactgcttgaaagggtagctaatacgggatattctggcctgctcgcatgggtgggtttggaaaggttttttctggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggccatcttctttgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcccctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgagcgtctgcctcagagatggggtttcctccttgtggggcgctttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttacggggagcggtcgaaggtggggctggtgattgggacgaagtcgtaacaaggtagccgtaccggaaggtgcggctggatcacctcctttct

SEQ ID NO: 96 - DNA, 1556 bp, Actinomyces viscosus
tttgtttggagagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatggcgggcctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgtcccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtagccgtaccggaaggtgcggctggatcacctcctttct

SEQ ID NO: 97 - DNA, 1331 bp, Adlercreutzia equolifaciens
gagtttgatcctggctcaggatgaacgctggcggcgtgcttaacacatgcaagtcgaacgagtggcgaacgggtgagtaacacgtgaccaacctgccccgcgctccgggacaaccgctggaaacggcggctaataccggatgctgaaagcggcgcgggatggggtcgcggcccattaggtagacggcggggtaacggcccaccgtgcccgcgatgggtagccggactgagaggtcgaccggccacattgggactgagatacggcccagactcctacgggaggcagcagtggggaattttgcgcaatgggggcaaccctgacgcagcaacgccgcgtgcgggacgaaggccttcgggttgtaaaccgctttcagcagggaagaagacggtacctgcagaagaagctccggctaactacgtgccagcagccgcggtaatacgtagggggcgagcgttatccggattcattgggcgtaaagcgcgcgtaggcggccgcctaagcggaacctctaatcccggggctcaacctcgggccgggttccggactgggcggctcgagtgcggtagaggcaggcggaattcccggtgtagcggtggaatgcgcagatatcgggaagaacaccgatggcgaaggcagcctgctgggccgactgacgctgaggcgcgaaagctgggggagcgaacaggattagataccctggtagtcccagccgtaaacgatggacgctaggtgtgggggcccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcgcaggtggtgcatggctgtcgtcagctcgtgtcgtgagatgttgggttaagtcccgcaacgagcgcaacccccgtcccgtgttgccagcatggggactcgcgggagactgccggcgtcaagccggaggaaggtggggacgacgtcaagtcatcatgccccttatgccctgggctgcacacgtgctacaatggccggcagagggttgccaccccgcgagggggagcggatcccggccggtcccagttcggacgcaggctgcaacccgcctgcggaagtcggagttgctagtaatcgcggatcagcatgccgcggtgaatacgttcccgggccttgtacacaccgcccgtcacaccacccgagtcgtctgcacccgaagccgccgccgacggaggcgtcgaaggtgtggagggtaaggggggtgaagtcgtaacaaggtaacc

SEQ ID NO: 98 - DNA, 1488 bp, Aerococcus sanguinicola
ctcaggacgaacgctggcggcatgcctaatacatgcaagtcgagcgaaccgacgaagtgcttgcacttctgacgttagcggcggacgggtgagtaacacgtaaggaacctacctatgagcgggggacaacatccggaaacgggtgctaataccgcatagtaatttgtcaggcatctgacaaattggaaagacggcttttgctgtcactcatagatggtcttgcggtgcattagctagttggtgggataaaagcttaccaaggccatgatgcatagccgacctgagagggtaatcggccacactgggactgagacacggcccagactcctacgggaggcagcagtagggaatcttccgcaatgggcgcaagcctgacggagcaatgccgcgtgagtgaagaaggttttcggatcgtaaaactctgttgtaagagaagaacaaattgtagagtaactgctacagtcttgacggtatcttaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtgcagaagaggaaagtggaactccatgtgtagcggtggaatgcgtagatatatggaagaacaccagtggcgaaggcgactttctggtctgtaactgacactgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcatttagttgggcactctagcgagactgccggtgacaaaccggaggaaggcggggatgacgtcaaatcatcatgccccttatgacttgggctacacacgtgctacaatggatggtacaacgggctgcgaactcgcgagagtcagcgaatcccttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaaca

SEQ ID NO: 99 - DNA, 1546 bp, Aerococcus urinae
atgagagtttgatcctggctcaggacgaacgctggcggcgtgcctaatacatgcaagtcgagcgaaccgaagaagtgcttgcacttctgacgttagcggcggacgggtgagtaacacgtaaggaacctaccgataagcgggggacaacatccggaaacgggtgctaataccgcataggaaacaccacctcatggtggtgtttggaaagacggctttgctgtcacttatcgatggccttgcggtgcattagctcgttggtggggtaacggcctaccaaggcaatgatgcatagccgacctgagagggtaatcggccacattgggactgagacacggcccaaactcctacgggaggcagcagtagggaatcttccgcaatgggcgcaagcctgacggagcaacgccgcgtgagtgaagaaggttttcggatcgtaaagctctgttgtaagagaagaacaaattggagagtaactgctccagtcttgacggtatcttaccagaaagccacggctaactacgtgccagcagccgcggtaatacgtaggtggcaagcgttgtccggatttattgggcgtaaagggggcgcaggcggtttcttaagtctgatgtgaaagcccacggcttaaccgtggaagtgcattggaaactggggaacttgagtacagaagaggaaagtggaactccatgtgtagcggtggaatgcgtagatatatggaagaacaccagtggcgaaggcgactttctggtctgtcactgacgctgaggcccgaaagcgtgggtagcaaacaggattagataccctggtagtccacgccgtaaacgatgagtgctaggtgttggagggtttccacccttcagtgccggagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccagcattgagttgggcactctagcgagactgccggtgacaaaccggaggaaggcggggatgacgtcaaatcatcatgccccttatgacttgggctacacacgtgctacaatggatggtacaacgagcagcgaccttgtgaaagcaagcgaatctcttaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacctgaagtcggtgaggtaacctttggagccagccgccgaaggtgggacagatgattggggtgaagtcgtaacaaggtagccgtaggtgaacctgcggctggatcacctcctttct

SEQ ID NO: 100 - DNA, 1419 bp, Aerococcus urinaeequi
  modified_base (1092)..(1092): a, c, t, g, unknown or other
acatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaaggagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattnagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagcc

SEQ ID NO: 101 - DNA, 1548 bp, Aerococcus viridans
atgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatattttcttccgcatggaagaagattgaaagacggctctgctgtcacttatagatgaccttgcggtgcattagttagttggtggggtaatggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttct

SEQ ID NO: 102 - DNA, 1357 bp, Aeromicrobium marinum
aagtygagcggtaaggctccttcgggagtacacgagcggcgaacgggtgagtaacacgtgagcaatctgcccttctcttcggaataaccattggaaacgatggctaatgccgaatacgacctcggatcacatgttctgaggtggaaagctccggcggagaaggatgagctcgcggcctatcagctagttggtgaggtaacggctcaccaaggcattgacgggtagccggcctgagagggtgaccggccacactgggactgagacacggcccagactcctacgggaggcagcagtggggaatattggacaatgggcgaaaccttgatccagcaacgccgcgtgagggatgacggccttcgggttgtaaacctctttcagcggggacgaagcgaaagtgacggtacccgcagaagaaggacckgccaactacgtgccagcagccgcggtaatacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacaggattagataccctggtagtccatgccgtaaacgttgggcgctaggtgtggggaccttccacggtctccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatataccggaaagctgcagagatgtagccccccttgtggtcggtatacaggtggtgcatggctgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaagtcttcatgccccttatgtccagggcttcaagcatgctacaatggccggtacaaagggctgcgaaaccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcgcaacacccgaagccagtg

SEQ ID NO: 103 - DNA, 1468 bp, Aeromicrobium sp. JC14
ctggctcaggacgaacgctggcggcgtgcttaacacatgcaagtcgagcggtaaggccctttcgggggtacacgagcggcgaacgggtgagtaacacgtgagcaatctgcccctgtctctgggataaccactggaaacggtggctaataccggatatgacctccttctgcatggttggtggtggaaaagtccgctggacagggatgagctcgcggcctatcagcttgttggtggggtaatggcctaccaaggcgacgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgaaagtgacggtacctgcagaagaaggaccggccaactacgtgccagcagccgcggtaatacgtagggtccgagcgttgtccggaattattgggcgtaaagggctcgtaggcggtttgtcacgtcgggagtgaaaactcagggcttaaccctgagcgtgcttccgatacgggctgactagagggatgcaggggagaacggaattcctggtgtagcggtggaatgcgcagatatcaggaggaacaccggtggcgaaggcggttctctgggcatttcctgacgctgaggagcgaaagcatggggagcgaacaggattagataccctggtagtccatgccgtaaacgttgggcgctaggtgtggggaccttccacggtttccgtgccgcagctaacgcattaagcgccccgcctggggagtacggccgcaaggctaaaactcaaaggaattgacgggggcccgcacaagcggcggagcatgctgattaattcgatgcaacgcgaagaaccttacctgggtttgacatatgccggaaagcgccagagatggtgcccctttttgtcggtatacaggtggtgcatggctgtcgtcagctcgtgtcgtgagatgttgggttaagtcccgcaacgagcgcaaccctcgtcctatgttgccagcacgttatggtggggactcataggagactgccggggtcaactcggaggaaggtggggatgacgtcaagtcatcatgccccttatgtccagggcttcaagcatgctacaatggccggtacaatgggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagccggtggcctaacccttgtggagggagccgtcgaaggtggggctggcgattgggacgaagtcgtaacaagtagccgta

SEQ ID NO: 104 - DNA, 1503 bp, Aeromonas allosaccharophila
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagcgaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatccctaagagattggggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 105 - DNA, 1490 bp, Aeromonas enteropelogenes
  modified_base (187)..(187): a, c, t, g, unknown or other
  modified_base (197)..(197): a, c, t, g, unknown or other
  modified_base (212)..(212): a, c, t, g, unknown or other
  modified_base (662)..(664): a, c, t, g, unknown or other
  modified_base (677)..(677): a, c, t, g, unknown or other
  modified_base (1009)..(1009): a, c, t, g, unknown or other
  modified_base (1107)..(1107): a, c, t, g, unknown or other
  modified_base (1115)..(1115): a, c, t, g, unknown or other
  modified_base (1329)..(1329): a, c, t, g, unknown or other
agtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgcctacgggggnaagcaggggnccttcgggccttgcncgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccggctagagtcttgtagaggggnnnagaattccaggtntagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggccgcacaagcggtggagcatgtggtttaattcgatgcaacgcgaagaaccttacctggccttgacatgtctggaatcctgcagagatncgggagtgccttcgggaatcagaacacaggtgctgcatggctgtcgtcagctcgtgtcgtgagatgttgggttaagtcccgcaacgagcgcaaccccngtcctttnttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcngaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgt

SEQ ID NO: 106 - DNA, 1547 bp, Aeromonas hydrophila
taaattgaagagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttgatgcctaatacgtatcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttac

SEQ ID NO: 107 - DNA, 1503 bp, Aeromonas jandaei
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgccctacgggggaaagcaggggaccttcgggccttgcgcgattggatgaacccaggtgggattagctagttggtgaggtaacggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 108 - DNA, 1546 bp, Aeromonas salmonicida
aaattgaagagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataacagttggaaacgactgctaataccgcatacgccctacgggggaaaggaggggaccttcgggcctttcgcgattggatgaacccaggtgggattagctagttggtggggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggcgcctaatacgtgtcaactgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaaccctaggggaacctggggttggatcacctccttac

SEQ ID NO: 109 - DNA, 1503 bp, Aeromonas trota
gagtttgatcatggctcagattgaacgctggcggcaggcctaacacatgcaagtcgagcggcagcgggaaagtagcttgctacttttgccggcgagcggcggacgggtgagtaatgcctgggaaattgcccagtcgagggggataacagttggaaacgactgctaataccgcatacgccctacgggggaaagcaggggaccttcgggccttgcgcgattggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggtcagtagctaatatctgctggctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggattggagtctgcaactcgactccatgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacaaggtaa

SEQ ID NO: 110 - DNA, 1532 bp, Aeromonas veronii
  modified_base (1495)..(1496): a, c, t, g, unknown or other
  modified_base (1510)..(1510): a, c, t, g, unknown or other
gagtttgatcatggctcagattgaacgctggcggcaggcctaacacatgcaagtcgagcggcagcgggaaagtagcttgctacttttgccggcgagcggcggacgggtgagtaatgcctggggatctgcccagtcgagggggataactactggaaacggtagctaataccgcatacgcctacgggggaaagcaggggaccttcgggccttgcgcgattggatgaacccaggtgggattagctagttggtgaggtaatggctcaccaaggcgacgatccctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagcgaggaggaaaggttggtagctaataactgccagctgtgacgttactcgcagaagaagcaccggctaactccgtgccagcagccgcggtaatacggagggtgcaagcgttaatcggaattactgggcgtaaagcgcacgcaggcggttggataagttagatgtgaaagccccgggctcaacctgggaattgcatttaaaactgtccagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggctgtgtccttgagacgtggcttccggagctaacgcgttaaatcgaccgcctggggagtacggccgcaaggttaaaactcaaatgaattgacgggggccgcacaagcggtggagcatgtggtttaattcgatgcaacgcgaagaaccttacctggccttgacatgtctggaatcctgtagagatacgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacagagggctgcaagctagcgatagtgagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgcaccagaagtagatagcttaaccttcgggagggcgtttaccacggtgtgattcatgactggggtgaagtcgtaacnnggtaaccctagggnaacctgcggctggatcacctcc

SEQ ID NO: 111 - DNA, 1420 bp, Afipia genomosp. 4
tggctcagagcgaacgctggcggcaggcttaacacatgcaagtcgaacgggcgtagcaatacgtcagtggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaaccgcaaggaggcagccggccacggtagggtcagcgactgggggaagt

SEQ ID NO: 112 - DNA, 1540 bp, Aggregatibacter actinomycetemcomitans
aattgaagagtttgatcatggctcagattgaacgctggcggcaggcttaacacatgcaagtcggacggtagcaggtaagtacttgtacttatgctgacgagtggcggacgggtgagtaatgcttgggaatctgtcttatggagggggataacgacgggaaactgtcgctaataccgcgtagaatcgggagatgaaagtgtgggaccttcgggccacatgccataggatgagcccaagtgtgattaggtagttggtggggtaaaggcctaccaagccgacgatcgctagctggtctgagaggatggccagccacaccgggactgagacacggcccggactcctacgggaggcagcagtggggaatattgcgcaatgggggcaaccctgacgcagccatgccgcgtgaatgaagaaggccttcgggttgtaaagttctttcggtgatgaggaaggttggtgtgttaatagcatgccaaattgacgttaaatacagaagaagcaccggctaactccgtgccagcagccgcggtaatacggggggtgcgagcgttaatcggaataactgggcgtaaagggcacgtaggcggacctttaagtgaggtgtgaaatccccgggcttaacctgggaattgcatttcatactgggggtctggagtactttagggaggggtagaattccacgtgtagcggtgaaatgcgtagagatgtggaggaataccgaaggcgaaggcagccccttggggatgtactgacgctgatgtgcgaaagcgtggggagcaaacaggattagataccctggtagtccacgctgtaaacggtgtcgatttggggattggggtttagccctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccgaagaagaactcagagatgggtttgtgccttagggagctttgagacaggtgctgcatggctgtcgtcagctcgtgttgtgaaatgttgggttaagtcccgcaacgagcgcaacccttatcctttgttgccagcgacttggtcgggaactcaaaggagactgccggtgataaaccggaggaaggtggggatgacgtcaagtcatcatggcccttacgagtagggctacacacgtgctacaatggcgtatacagagggtaaccaaccagcgatggggagtgaatctcagaaagtacgtctaagtccggattggagtctgcaactcgactccatgaagtcggaatcgctagtaatcgcgaatcagaatgttgcggtgaatacgttcccgggccttgtacacaccgcccgtcacaccatgggagtgggttgtaccagaagtagatagcttaaccgagaggggggcgtttaccacggtatgattcatgactggggtgaagtcgtaacaaggtaaccgtaggggaacctgcggttggatcacctccttac

SEQ ID NO: 113 - DNA, 1539 bp, Aggregatibacter aphrophilus
aattgaagagtttgatcatggctcagattgaacgctggcggcaggcttaacacatgcaagtcgaacggtagcaggtaagtacttgtacttatgctgacgagtggcggacgggtgagtaatgcttggggatctggcttatggagggggataacgacgggaaactgtcgctaataccgcgtagaatcgggagatgaaagtgtgggaccttcgggccacatgccataggatgagcccaagtgggattaggtagttggtggggtaatggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggaaggttgttgtgttaatagcgcaacaaattgacgttaatcacagaagaagcaccggctaactccgtgccagcagccgcggtaatacggagggtgcgagcgttaatcggaataactgggcgtaaagggcacgcaggcggacttttaagtgaggtgtgaaatccccgggcttaacctgggaattgcatttcagactgggggtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacggtgtcgatttggggattgtgctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgatttggtcgggaactcaaaggagactgccggtgataaaccggaggaaggtggggatgacgtcaagtcatcatggcccttacgagtagggctacacacgtgctacaatggcgtatacagagggcgacgaagccgcgaggtggagtgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcggggggcgtttaccacggtatgattcatgactggggtgaagtcgtaacaaggtaaccgtaggggaacctgcggttggatcacctccttac

SEQ ID NO: 114 - DNA, 1543 bp, Aggregatibacter segnis
ttgaactgaagagtttgatcatggctcagattgaacgctggcggcaggcttaacacatgcaagtcgaacggtaacaggagagagcttgctttcttgctgacgagtggcggacgggtgagtaatgcttgggaatctggcttatggagggggataacgacgggaaactgtcgctaataccgcgtagagtcgagagacgaaagtgcgggaccgcaaggccgcatgccataggatgagcccaagtgggattaggtagttggtggggtaatggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggaaggcgtgatgtttaataggcatcacgattgacgttaatcacagaagaagcaccggctaactccgtgccagcagccgcggtaatacggagggtgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggccttgagcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggcgacgaagccgcgaggtggagtgaatctcacaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttac

SEQ ID NO: 115 - DNA, 1492 bp, Agrobacterium radiobacter
ctcaacatgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgtgtccttcgggagaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcctgtgttacccgtagagatatggggtccacttcggtggcgcagagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaaggaag

SEQ ID NO: 116 - DNA, 1437 bp, Agrobacterium tumefaciens
aacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacc

SEQ ID NO: 117 - DNA, 1473 bp, Agrococcus jenensis
gacgaacgctggcggcgtgcttaacacatgcaagtcgaacgatgaaggaggagcttgctcctccggattagtggcgaacgggtgagtaatacgtgagcaatgtgcccttgactctgggataagcgctggaaacggcgtctaataccggatacgacgaccggaggcatctcctggtcgtggaaagaacttcggtcaaggatcagctcacggcctatcagctagttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgaaggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcacgtctgctgtgaaaacccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcaaacaggcttagataccctggtagtccatgccgtaaacgttgggaactagatgtggggaccattccacggtctccgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgcactggagacagtgaactctttggacactcgtatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgaggtcaaatcatcatgccccttatgtcttgggcttcacgcatgctacaatggccggtacaatgggctgcgataccgcaaggtggagcgaatcccaaaaagccggtctcagttcggattgaggtctgcaactcgacctcatgaagtcggagtcgctagtaatcgtagatcagcaacgctacggtgaatacgttcccgggccttgtacacaccgcccgtcaagtcatgaaagtcggtaacacccgaagccagtggcctaaccttttggagggagctgtcgaaggtgggatcggtgattaggactaagtcgtaacaaggtagccgtaccggaa

SEQ ID NO: 118 - DNA, 1368 bp, Akkermansia muciniphila
tcgaacgagagaattgctagcttgctaataattctctagtggcgcacgggtgagtaacacgtgagtaacctgcccccgagagcgggatagccctgggaaactgggattaataccgcatagtatcgaaagattaaagcagcaatgcgcttggggatgggctcgcggcctattagttagttggtgaggtaacggctcaccaaggcgatgacgggtagccggtctgagaggatgtccggccacactggaactgagacacggtccagacacctacgggtggcagcagtcgagaatcattcacaatgggggaaaccctgatggtgcgacgccgcgtgggggaatgaaggtcttcggattgtaaacccctgtcatgtgggagcaaattaaaaagatagtacccaagaggaagagacggctaactctgtgccagcagccgcggtaatacagaggtctcaagcgttgttcggaatcactgggcgtaaagcgtgcgtaggctgtttcgtaagtcgtgtgtgaaaggcgcgggctcaacccgcggacggcacatgatactgcgagactagagtaatggagggggaaccggaattctcggtgtagcagtgaaatgcgtagatatcgagaggaacactcgtggcgaaggcgggttcctggacattaactgacgctgaggcacgaaggccaggggagcgaaagggattagatacccctgtagtcctggcagtaaacggtgcacgcttggtgtgcggggaatcgaccccctgcgtgccggagctaacgcgttaagcgtgccgcctggggagtacggtcgcaagattaaaactcaaagaaattgacggggacccgcacaagcggtggagtatgtggcttaattcgatgcaacgcgaagaaccttacctgggcttgacatgtaatgaacaacatgtgaaagcatgcgactcttcggaggcgttacacaggtgctgcatggcggtcgtcagctcatgtcctgagatgtttggttaagtccagcaacgagcgcaacccctgttgccagttaccagcacgtgaaggtggggactctggcgagactgcccagatcaactgggaggaaggtggggacgacgtcaggtcagtatggcccttatgcccagggctgcacacgtactacaatgcccagtacagagggggccgaagccgcgaggcggaggaaatcctgaaaactgggcccagttcggactgtaggctgcaacccgcctacacgaagccggaatcgctagtaatggcgcatcagctacggcgccgtgaatacgttcccgggtcttgtacacaccgcccgtcacatcatggaagccggtcgcacccgaagtatctgaagccaaccgcaaggaggca

SEQ ID NO: 119 - DNA, 1462 bp, Alcaligenes faecalis
  modified_base (432)..(432): a, c, t, g, unknown or other
  modified_base (446)..(446): a, c, t, g, unknown or other
attgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtanctcctaatacgagntactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgcttaccacggtgggattcatgactggggtgaag

SEQ ID NO: 120 - DNA, 1499 bp, Alcaligenes sp. CO14
gagtttgatcctggctcagattgaacgctagcgggatgctttacacatgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtatctcctaatacgagatactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaaggggggtagaattccacgtgtagcagtgaaatgcgtagatatgtggaggaataccgatggcgaaggcagccccctgggataatactgacgctcagacacgaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgt

SEQ ID NO: 121 - DNA, 1404 bp, Alcaligenes sp. S3
atgcaagtcgaacggcagcgcgagagagcttgctctcttggcggcgagtggcggacgggtgagtaatatatcggaacgtgcccagtagcgggggataactactcgaaagagtggctaataccgcatacgccctacgggggaaagggggggatcgcaagacctctcactattggagcggccgatatcggattagctagttggtggggtaaaggctcaccaaggcaacgatccgtagctggtttgagaggacgaccagccacactgggactgagacacggcccagactcctacgggaggcagcagtggggaattttggacaatgggggaaaccctgatccagccatcccgcgtgtatgatgaaggccttcgggttgtaaagtacttttggcagagaagaaaaggtacctcctaatacgaggtactgctgacggtatctgcagaataagcaccggctaactacgtgccagcagccgcggtaatacgtagggtgcaagcgttaatcggaattactgggcgtaaagcgtgtgtaggcggttcggaaagaaagatgtgaaatcccagggctcaaccttggaactgcatttttaactgccgagctagagtatgtcagaggggggtagaattccacgtgtagcagtgaaatgcgtagatatgtggaggaataccgatggcgaaggcagccccctgggataatactgacgctcagacacgaaagcgtggggagcaaacaggattagataccctggtagtccacgccctaaacgatgtcaactagctgttggggccgttaggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaaagccgaagagatttggccgtgctcgcaagagaaccggaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcgggacagagggtcgccaacccgcgagggggagccaatctcagaaacccgatcgtagtccggatcgcagtctgcaactcgactgcgtgaagtcggaatcgctagtaatcgcggatcagaatgtcgcggtgaatacgttcccgggtcttgtacacaccgcccgtcacaccatgggagtgggtttcaccagaagtaggtagcctaaccgtaaggagggcgct

SEQ ID NO: 122 - DNA, 1528 bp, Alicyclobacillus acidocaldarius
agagtttgatcctggctcaggacgaacgctggcggcgtgcctaatacatgcaagtcgagcggacctcttttgaggtcagcggcggacgggtgaggaacacgtgggtaatctgcctttcagaccggaataacgcccggaaacgggcgctaatatgccggatacgcccgcgaggaggcatcttcttgcggggaaaggcccgattgggccgctgagagaggagcccgcggcgcattagctagttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcggcatggggagtggaaagccccatgcgagacggtaccgagtgaggaagccccggctaactacgtgccagcagccgcggtaaaacgtagggggcgagcgttgtccggaatcactgggcgtaaagggtgcgtaggcggtcgagcaagtctggagtgaaagtccatggctcaaccatgggatggctctggaaactgcttgacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgggtgcagagatgcaccttcccttcggggcagaggagacaggtggtgcatggttgtcgtcagctcgtgtcgtgagatgttgggttcagtcccgcaacgagcgcaacccttgacctgtgttaccagcgcgttgaggcggggactcacaggtgactgccggcgcaagtcggaggaaggcggggatgacgtcaaatcatcatgcccctgatgtcctgggctacacacgtgctacaatgggcggtacaaagggaggcgaagccgcgaggcggagcgaaacccaaaaagccgctcgtagttcggattgcaggctgcaactcgcctgcatgaagccggaattgctagtaatcgcggatcagcatgccgcggtgaatacgttcccgggccttgtacacaccgcccgtcacaccacgagagtcggcaacacccgaagtcggtgaggtaaccccgaaaggggagccagccgccgaaggtggggtcgatgattggggtgaagtcgtaacaaggtagccgtaccggaaggtgcggctggatcacct

SEQ ID NO: 123 - DNA, 1514 bp, Alicyclobacillus acidoterrestris
agagtttgatcctggctcaggacgaacgctggcggcgtgcctaatacatgcaagtcgagcgagcccttcggggctagcggcggacgggtgagtaacacgtgggcaatctgcctttcagactggaataacactcggaaacgggtgctaatgccggataatacacgggtaggcatctacttgtgttgaaagatgcaactgcatcgctgagagaggagcccgcggcgcattagctagttggtgaggtaacggctcaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctctgttgctcggggagagcgacaaggagagtggaaagctccttgtgagacggtaccgagtgaggaagccccggctaactacgtgccagcagccgcggtaatacgtagggggcaagcgttgtccggaatcactgggcgtaaagcgtgcgtaggcggttgtgtaagtctgaagtgaaagtccaaggctcaaccttgggattgctttggaaactgcatgacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttggggggacacaccccagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgcagagatgtaccttcccttcggggcagaggagacaggtggtgcatggttgtcgtcagctcgtgtcgtgagatgttgggttaagtcccgcaacgagcgcaacccttgatctgtgttaccagcacgtagaggtggggactcacaggtgactgccggcgtaagtcggaggaaggcggggatgacgtcaaatcatcatgccctttatgtcctgggctacacacgtgctacaatgggcggtacaacgggaagcgaagccgcgaggtggagcaaaacctaaaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtgaggtaaccgttatggagccagccgccgaaggtggggttgatgattggggtgaagtcgtaacaaggtagccgtatcggaaggtgcggttgga

SEQ ID NO: 124 - DNA, 1520 bp, Alicyclobacillus contaminans
  modified_base (182)..(182): a, c, t, g, unknown or other
  modified_base (192)..(192): a, c, t, g, unknown or other
  modified_base (476)..(476): a, c, t, g, unknown or other
tagagtttgatcatggctcaggacgaacgctggcggcgtgcctaatacatgcaagtcgagcggacggaagggagcttgctcctggaagtcagcggcggacgggtgagtaacacgtgggtaatctgcctgtcagaccggaataacgcctggaaacgggtgctaatgccggatagtcagtcttngggcatcttnggactgggaaaggcgctaaggcgtcactgacagaggagcccgcggcgcattagctagttggtggggtaaaggcctaccaaggcgacgatgcgtagccgacctgagagggtgaccggccacactgggactgagacacggcccagactcctacgggaggcagcagtagggaatcttcggcaatgggcgaaagcctgaccgagcaacgccgcgtgagcgaagaaggccttcgggttgtaaagctcagtcactcgggaagagcgaaccggagagggaatgctctggtngagacggtaccgagagaggaagccccggctaactacgtgccagcagccgcggtaatacgtagggggcgagcgttgtccggaatcactgggcgtaaagcgtgcgtaggcggtttggtaagtccggagtgaaagaccagggctcaaccctgggggtgctttggaaactgccagacttgagtgctggagaggcaaggggaattccacgtgtagcggtgaaatgcgtagagatgtggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgggttcagagatgagccgtcccttcggggcagaggagacaggtggtgcatggttgtcgtcagctcgtgtcgtgagatgttgggttaagtcccgcaacgagcgcaacccttgacctgtgttaccagcacgtgaaggtggggactcacaggtgactgccggcgtaagtcggaggaaggtggggatgacgtcaaatcatcatgccctttatgtcctgggctacacacgtgctacaatgggcggtacaacgggaagcgagaccgcgaggtggagcgaaaccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagttggcaacacccgaagtcggtgaggtaaccctttagggagccagccgccgaaggtggggtcgatgattggggtgaagtcgtaacaaggtagccgtatcggaagg

SEQ ID NO: 125 - DNA, 1517 bp, Alicyclobacillus cycloheptanicus
agagtttgatcctggctcaggacgaacgctggcggcgtgcctaatacatgcaagtcgagcggacccttcggggtcagcggcggacgggtgagtaacacgtgggtaatctgcccaactgaccggaataacgcctggaaacgggtgctaatgccggataggcagcgagcaggcatctgctcgctgggaaaggtgcaaatgcaccgcagatggaggagcccgcggcgcattagctggttggtggggtaacggctcaccaaggcgacgatgcgtagccgacctgagagggtggacggccacactgggactgagacacggcccagactcctacgggaggcagcagtagggaatcttccgcaatgggcgcaagcctgacggagcaacgccgcgtgagcgaagaaggccttcgggttgtaaagctcagtcactcgggaagagcggcaaggggagtggaaagccccttgagagacggtaccgagagaggaagccccggctaactacgtgccagcagccgcggtaatacgtagggggcaagcgttgtccggaatcactgggcgtaaagcgtgcgtaggcggttgcgtgtgtccggggtgaaagtccagggctcaaccctgggaatgccttggaaactgcgtaacttgagtgctggagaggcaaggggaattccgcgtgtagcggtggaatgcgtagatatgcggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccccctgacagccgcagagatgcggtttcccttcggggcaggggagacaggtggtgcatggttgtcgtcagctcgtgtcgtgagatgttgggttaagtcccgcaacgagcgcaacccttgaactgtgttaccagcacgtgaaggtggggactcacagttgactgccggcgtaagtcggaggaaggcggggatgacgtcaaatcatcatgccctttatgtcctgggctacacacgtgctacaatgggcggtacaacgggaagcgagaccgcgaggtggagcaaacccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagtcggcaacacccgaagtcggtggggtaacccgtcagggggccagccgccgaaggtggggttgatgattggggtgaagtcgtaacaaggtagccgtatcggaaggtgcggttggat

SEQ ID NO: 126 - DNA, 1529 bp, Alicyclobacillus herbarius
  modified_base (1025)..(1025): a, c, t, g, unknown or other
  modified_base (1027)..(1027): a, c, t, g, unknown or other
  modified_base (1135)..(1135): a, c, t, g, unknown or other
  modified_base (1138)..(1138): a, c, t, g, unknown or other
  modified_base (1331)..(1331): a, c, t, g, unknown or other
agagtttgatcctggctcaggacgaacgctggcggcgtgcctaatacatgcaagtcgagcggacggaagggagcttgctcccggacgtcagcggcggacgggtgaggaacacgtgggcaatctgcccatcagtcgggaataacactcggaaacgggtgctaatgccggataggcatcttgggggcatccctgggatgggaaaggcgcttaggcgctgctgatggaggagcccgcggcgcattagctggttggcggggtaacggcccaccaaggcgacgatgcgtagccgacctgagagggtgaccggccacactgggactgagacacggcccagactcctacgggaggcagcagtagggaatcttccgcaatgggcgcaagcctgacggagcaacgccgcgtgagcgaagaaggccttcgggttgtaaagctcagtcaatcgggaagagcgacctagggagggaatgccctaggggagacggtaccgatggaggaagccccggcaaactacgtgccagcagccgcggtaatacgtagggggcgagcgttgtccggaatgactgggcgtaaagcgtgcgtaggcggccttacgcgtctgaggtttaagaccacggctcaaccgtgggggtgccttggaaacggtgaggcttgagtgctggagaggcaaggggaattccacgtgtagcggtgaaatgcgtagagatgtggaggaatacccgtggcgaaggcgccttgctggacagtgactgacgctgaggcacgaaagcgtggggagcaaacaggattagataccctggtagtccacgccgtaaacgatgagtgctaggtgttgggggtgcgagccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgcactcagagatgggtgttcccntntgggcagaggagacaggtggtgcatggttgtcgtcagctcgtgtcgtgagatgttgggttaagtcccgcaacgagcgcaacccttgacctgtgttaccagcgcgtganggnggggactcacaggtgactgccggcgcaagccggaggaaggcggggatgacgtcaaatcatcatgcccttgatgtcctgggcgacacacgtgctacaatgggcggtacaacgggcagcgagaccgcgaggtggagcgaatccctgaaagccgctcgtagttcggattgcaggctgcaacccgcctgcatgaagncggaattgctagtaatcgcggatcagcatgccgcggtgaatccgttcccgggccttgtacacaccgcccgtcacaccacgagagtgagcaacacccgaagtcggtgaggcaaccggataggagccagccgccgaaggtggggctcgcgattggggtgaagtcgtaacaaggtagccgtatcggaaggtgcggttggat

SEQ ID NO: 127 - DNA, 1528 bp, Alicyclobacillus pomorum
  modified_base (1017)..(1017): a, c, t, g, unknown or other
agagtttgatcctggctcaggacgaacgctggcggcgtgcctaatacatgcaagtcgagcggacggaagggagcttgctcccggaagtcagcggcggacgggtgagtaacacgtgggcaatctgcctgtcagaccggaataacgcctggaaacgggtgctaatgccggataggcaatctggaggcatctctggattgggaaaggcgcggatgcgccactgacagaggagcccgcggcgcattagctagttggtggggtaacggctcaccaaggcgacgatgcgtagccgacctgagagggtgaccggccacactgggactgagacacggcccagactcctacgggaggcagcagtagggaatcttcggcaatgggcgaaagcctgaccgagcaacgccgcgtgagcgaagaaggccttcgggttgtaaagctcagtcactcgggaagagcggtaaggagaggaaatgctcctttcgagacggtaccgagagaggaagccccggctaactacgtgccagcagccgcggtaatacgtagggggcgagcgttgtccggaatcactgggcgtaaagcgtgcgtaggcggtttgttaagtccgaagtgaaagtccagggctcaaccttgggattgctttggaaactggcagacttgagtgctggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttggggggtaccaccctcagtgccgaaggaaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgaccggtgcagagatgtnccttcccttcggggcagaggagacaggtggtgcatggttgtcgtcagctcgtgtcgtgagatgttgggttaagtcccgcaacgagcgcaacccttgacctgtgttaccagcacgtgatggtggggactcacaggtgactgccggcgtaagtcggaggaaggtggggatgacgtcaaatcatcatgccctttatgtcctgggctacacacgtgctacaatgggcggtacaacgggaagcgagaccgcgaggtggagcgaatccctgaaagccgttcgtagttcggattgcaggctgcaactcgcctgcatgaagccggaattgctagtaatcgcggatcagcatgccgcggtgaatccgttcccgggccttgtacacaccgcccgtcacaccacgagagttggcaacacccgaagtcggtgaggtaaccgcaaggagccagccgccgaaggtggggtcgacgattggggtgaagtcgtaacaaggtagccgtatcggaaggtgcggttggat

SEQ ID NO: 128 - DNA, 1464 bp, Alicyclobacillus sp. CCUG 53762
aacgctggcggcgtgcctaatacatgcaagtcgcgcgaacggaaggagagcttgctcttctgaagttagcggcggacgggtgagtaacacgtgggcaacctgcctgacagaccgggataacgcttggaaacgagtgctaataccggataggcaaacgggaggcatctcctgattgagaaaggcgctacggcgtcactgtcagatgggcccgcggcgcattagctagttggtgaggtaacggctcaccaaggcgacgatgcgtagccgacctgagagggtgaccggccacactgggactgagacacggcccagactcctacgggaggcagcagtagggaatcttccacaatgggcgcaagcctgatggagcaacgccgcgtgagtgatgaaggccttcgggttgtaaaactctgtcttctgggacgaacgggcaggagagggaatgctcctgccatgacggtaccagaggaggaagccacggctaactacgtgccagcagccgcggtaatacgtaggtggcaagcgttgtccggaattactgggcgtaaagcgcgcgcaggcggccatttaagtctggggtgaaagcccggggctcaaccccgggattgccttggatactggatggcttgagcatcggagaggcaaggggaattccacgtgtagcggtgaaatgcgtagagatgtggaggaacaccagtggcgaaggcgccttgctggccgattgctgacgctgaggcgcgaaagcgtggggagcaaacaggattagataccctggtagtccacgccgtaaacgatgagtgctaggtgttggcggtttcaataccgtcagtgccgaagctaacgcattaagcactccgcctggggagtacggtcgcaagactgaaactcaaaggaattgacgggggcccgcacaagcagtggagcatgtggtttaattcgaagcaacgcgaagaaccttaccaagacttgacatcccgctgaccggtctagagataggccttcccttcggggcagcggagacaggtggtgcatggttgtcgtcagctcgtgtcgtgagatgttgggttaagtcccgcaacgagcgcaacccttgaactgtgttgccagcattgagttgggcactcacagttgactgccggtgacaaaccggaggaaggcggggatgacgtcaaatcatcatgccccttatgtcttgggctacacacgtgctacaatgggcggtacagagggatgcgaaaccgcgaggtggagcgaaacccttaaagccgttcgtagttcggattgcaggctgcaactcgcctgcatgaagccggaattgctagtaatcgcggatcagcatgccgcggtgaatacgttcccgggccttgtacacaccgcccgtcacaccacgagagttggtaacacccgaagtcggtgaggtaaccttatggagccagccgccgaaggtgggatcgatgattgggg

SEQ ID NO: 129 - DNA, 1384 bp, Alistipes finegoldii
  modified_base (24)..(25): a, c, t, g, unknown or other
  modified_base (27)..(27): a, c, t, g, unknown or other
gtcgaggggcagcggggagtagcnngnctccgccggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtactagggtaaacgcttctacgtgtaggagcctgaaagtatagtacgaataaggatcggctaactccgtgccagcagccgcggtaatacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagtgacgattctggaaacaggatttcccttcggggcacgaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggccgctaccccgcgaggggatgccaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaaggagc

SEQ ID NO: 130 - DNA, 1317 bp, Alistipes indistinctus
gataaacgctagcggcaggcctaacacatgcaagtcgagggaccggcgcacgggtgcgtaacgcgtatgcaacctacctttaacagggggataatccgaagaaatttggtctaataccccataatgaaaaatggttagagatgggcatgcgttgtattagctagttggtgaggtaacggctcaccaaggctacgatacatagggggactgagaggttttccccccacactggtactgagacacggaccagactcctacgggaggcagcagtgaggaatattggtcaatggacgcaagtctgaaccagccatgccgcgtgcaggatgaaggtgtatgcattgtaaactgcttttgtacgagggtatgaaagtatcgtacgaataagggtcggctaactccgtgccagcagccgcggtaatacggaggacccgagcgttatccggatttattgggtttaaagggtgcgtaggcggattagtaagttagaggtgaaagctcgatgctcaacatcgaaattgcctctgatactgttagtctagagtatagttgcggaaggcggaatgtgtggtgtagcggtgaaatgcttagatatcacacagaacaccgattgcgaaggcagctttccaagctaactgacgctgatgcacgaaagcgtggggagcgaacaggattagataccctggtagtccacgccgtaaacgatgataactcgttgcaggcgagtctgtgacttagcgaaagcgttaagttatccacctggggagtacgttcgcaagaatgaaactcaaaggaattgacgggggcccgcacaagcggaggaacatgtggtttaattcgatgatacgcgaggaaccttacccgggcttgaaagtactaggtgctgcatggttgtcgtcagctcgtgccgtgaggtgtcgggttaagtcccataacgagcgcaacccctactgttagttaccagcacgtgggcactctagcaggactgccggtgtaagccggaggaaggtggggatgacgtcaaatcagcacggcccttacgtccggggcgacacacgtgttacaatggtcggcagagggtcgctaccccgtgaggggatgccaatctcgccgatctcagttcggatggaggctgaaactcgcctccagaagttggattcgctagtaatcgcgcatcagccatggcgcggtgaatacgttcccgggccttgtacacaccgcccgtcaagccatgggagttgggggtgcctgaagtacgtgcgtcctagggcaaaaccgatgactggggctaagtcgtaacaaggtagccgtaccggaagg

SEQ ID NO: 131 - DNA, 932 bp, Alistipes onderdonkii
  modified_base (16)..(16): a, c, t, g, unknown or other
  modified_base (18)..(18): a, c, t, g, unknown or other
  modified_base (99)..(99): a, c, t, g, unknown or other
  modified_base (137)..(137): a, c, t, g, unknown or other
  modified_base (151)..(151): a, c, t, g, unknown or other
atcgtacgaataaggntnggctaactccgtgccagcagccgcggtaatacggaggattcaagcgttatccggatttattgggtttaaagggtgcgtagncggtttgataagttagaggtgaaatcccggggcttaantccggaactgcctntaatactgttagactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattggatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggtcgctaccccgtgaggggatgccaatctcgaaagcctatctcagttcggattggaggctgaaacccgcctccatgaagttggattcgctagtaatcgcgcatcagccatggcgcggtgaatacgttcccgggccttgtacacaccgcccgtcaagccatggaagctg

SEQ ID NO: 132 - DNA, 1523 bp, Alistipes putredinis
gagagtttgatcctggctcaggatgaacgctagcggcaggcttaacacatgcaagtcgaggggcagcataatggatagcaatatctatggtggcgaccggcgcacgggtgcgtaacgcgtatgcaacctacctttaacagggggataacactgagaaattggtactaataccccataatatcatagaaggcatcttttatggttgaaaattccgatggttagagatgggcatgcgttgtattagctagttggtggggtaacggctcaccaaggcgacgatacatagggggactgagaggttaaccccccacactggtactgagacacggaccagactcctacgggaggcagcagtgaggaatattggtcaatggacgcaagtctgaaccagccatgccgcgtgcaggatgacggctctatgagttgtaaactgcttttgtacgagggtaaacgcagatacgtgtatctgtctgaaagtatcgtacgaataaggatcggctaactccgtgccagcagccgcggtaatacggaggattcaagcgttatccggatttattgggtttaaagggtgcgtaggcggtttgataagttagaggtgaaatttcggggctcaaccctgaacgtgcctctaatactgttgagctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagcgacgattcttgaaagaggatttcccttcggggcgcgaaactaggtgctgcatggttgtcgtcagctcgtgccgtgaggtgtcgggttaagtcccataacgagcgcaacccctaccgttagttgccatcaggtgaagctgggcactctggcgggactgccggtgtaagccgagaggaaggtggggatgacgtcaaatcagcacggcccttacgtccggggctacacacgtgttacaatggtaggtacagagggcagctacccagcgatgggatgcgaatctcgaaagcctatctcagttcggattggaggctgaaacccgcctccatgaagttggattcgctagtaatcgcgcatcagccatggcgcggtgaatacgttcccgggccttgtacacaccgcccgtcaagccatgggagccgggggtgcctgaagttcgtgaccgcaaggagcgacctagggcaaaactggtgactggggctaagtcgtaacaaggtagccgtaccggaaggtgcggctggaacacctcctttct

SEQ ID NO: 133 - DNA, 1355 bp, Alistipes shahii
  modified_base (753)..(753): a, c, t, g, unknown or other
gcaatacactggtggcgaccggcgcacgggtgcgtaacgcgtatgcaacctacccataacagggggataacactgagaaattggtactaataccccataacatcaggaccggcatcggttttggttgaaaactccggtggttatggatgggcatgcgttgtattagctggttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacggctctatgagttgtaaactgcttttgtacgagggtaaacgctcttacgtgtaagagcctgaaagtatcgtacgaataaggtcggctaactcgtgccagcagccgcggtaatacggaggcaagcgttatccggatttattgggtttaaagggtgcgtaggcggtttgataagttagaggtgaaataccggtgcttaacaccggaactgcctctaatactgttgactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgctgtcggcgatacacngtcggcggctaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggcagctacccagtgatgggatgcgaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaagga

SEQ ID NO: 134 - DNA, 1432 bp, Alistipes sp. HGB5
ggcgaccggcgcacgggtgcgtaacgcgtatgcaacctacctttaacaggggcataacactgagaaattggtactaattccccataacattcgagaaggcatcttcttgggttaaaaactccggtggttaaagatgggcatgcgttgtattagctagttggtgaggtaacggctcaccaaggcaacgatacatagggggactgagaggttaaccccccacattggtactgagacacggaccaaactcctacgggaggcagcagtgaggaatattggtcaatggacgcaagtctgaaccagccatgccgcgtgcaggaagacagctctatgagttgtaaactgcttttgtactagggtaaacgctcctacgtgtaggagtctgaaagtatagtacgaataaggatcggctaactccgtgccagcagccgcggtaatacggaggatccaagcgttatccggatttattgggtttaaagggtgcgtaggcggtttgataagttagaggtgaaataccggggctcaactccggaactgcctctaatactgttgaactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttagtgacgattctggaaacaggatttcccttcggggcacgaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggccgctaccccgtgaggggatgccaatctcgaaagcctatctcagttcggatcggaggctgaaacccgcctccgtgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtgactggggctaagtcgtaacaaggtagccgtaccggaaggtgcggctggaacacctcctttct

SEQ ID NO: 135 - DNA, 1480 bp, Alistipes sp. JC50
tgatcctggctcaggatgaacgctagcggcaggcctaacacatgcaagtcgaggggcagcgggattgaagcttgcttcaattgccggcgaccggcgcacgggtgcgtaacgcgtatgcaacctacccataacagggggataacactgagaaatcggtactaatatcccataacatcatgaggggcatcccttatggttgaaaactccggtggttatggatgggcatgcgttgtattagctggttggtgaggtaacggctcaccaaggcgacgatacatagggggactgagaggttaaccccccacattggtactgagacacggaccaaactcctacgggaggcagcagtgaggaatattggtcaatggacgcaagtctgaaccagccatgccgcgtgcaggatgacggctctatgagttgtaaactgcttttgtacgagggtaaacccggatacgtgtatccggctgaaagtatcgtacgaataaggatcggctaactccgtgccagcagccgcggtaatacggaggattcaagcgttatccggatttattgggtttaaagggtgcgtaggcggtttgataagttagaggtgaaataccggtgcttaacaccggaactgcctctaatactgttgagctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgctgtcggcgatacacagtcggtggctaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggcagctacccagtgatgggatgcgaatctcgaaagcctatctcagttcggattggaggctgaaacccgcctccatgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtgactggggctaagtcgtaacaaggta

SEQ ID NO: 136 - DNA, 1304 bp, Alistipes sp. RMA 9912
gctcaggatgaacgctagcggcaggcctaacacatgcaagtcgagggaccggcgcacgggtgcgtaacgcgtatgtaacctacctataacaggggcataacactgagaaattggtactaattccccataatgaaaagtggttatagatggacatgcgttgtattagctagttggtgaggtaacggctcaccaaggcaacgatacatagggggactgagaggttaaccccccacactggtactgagacacggaccagactcctacgggaggcagcagtgaggaatattggtcaatggacgcaagtctgaaccagccatgccgcgtgcaggaagacggcttatgagttgtaaactgcttttgtacgagggtatgaaagtatcgtacgaataaggatcggctaactccgtgccagcagccgcggtaatacggaggattcaagcgttatccggatttattgggtttaaagggtgcgtaggcggtttgataagttagaggtgaaatcccggggcttaactccggaactgcctctaatactgttagactagagagtagttgcggtaggcggaatgtatggtgtagcggtgaaatgcttagagatcatacagaacaccgattgcgaaggcagcttaccaaactatctgacgttgaggcacgaaagcgtggggagcaaacaggattagataccctggtagtccacgcagtaaacgatgataactcgttgtcggcgagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagtactaggtgctgcatggttgtcgtcagctcgtgccgtgaggtgtcgggttaagtcccataacgagcgcaacccctaccgttagttgccatcagctgggcactctggcgggactgccggtgtaagccggaggaaggtggggatgacgtcaaatcagcacggcccttacgtccggggctacacacgtgttacaatggtaggcagagggtcgctactccgtgaggagatgccaatctcgcctatctcagttcggatggaggctgaaacccgcctccagaagttggattcgctagtaatcgcgcatcagccatggcgcggtgaatacgttcccgggccttgtacacaccgcccgtcaagccatggaagctgggggtgcctgaagttcgtgcgacctagggcaaaaccggtaactggggctaagtcgtaaca

SEQ ID NO: 137 - DNA, 1404 bp, Alkaliphilus metalliredigenes
  modified_base (133)..(133): a, c, t, g, unknown or other
  modified_base (151)..(151): a, c, t, g, unknown or other
  modified_base (674)..(675): a, c, t, g, unknown or other
cctccttagagtttgatcctggctcaggatgaacgctggcggcgtgcctaacacatgcaagtcgagcgggttaatctgacggaagccttcgggtggaagaaagtgaaactagcggcggacgggtgagtaacgncgtgggcaacctaccttngtacagggggacaacaacgggaaaccgttgctaataccccataaaaccctagaggggcatcccttaagggtcaaagaatttcggtacaagatgggcccgcgtctgattagctagttggtgaggtaatggctcaccaaggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctaggggaagaatattgacggtaccctaggaggaagccccggctaactacgtgccagcagccgcggtaatacgtagggggcaagcgttatccggaatcactgggcgtaaagggtgcgtaggcggtcttgcaagtcagaggtgaaaggctacggctcaaccgtagtaagcctttgaaactgctaagacttgagtatgggagaggaaagtggaattcctagnntagcggtgaaatgcgtagatattaggaggaacaccagtggcgaaggcgactttctggacccattactgaccgctgaggcacgaaaagcgtgggggagcaaacaggattagataccctggtagtccacgccgtaaacaatgagtgctaggatgttgggggtcgaacctcagtgccgcagctaacgcattaagcactccgcctggggagtacgctcacaagcagtgaaactcaaaggaattgactggggacccgcacaagcagctggagcatgtggtttaattcgaagcaacgcgaagaaccttacctggacgttgacatccctcggaccactccttaaccggagtcttcccttcggggactgaggtgacaggtggtgcatggttgtcgtcagctcgtgtcgtgagatgttgggttaagtcccgcaacgagcgcaacccttgtctttagttgccagcagttcggctgggcactctagagagactgccggggataactcggaggaaggtggggatgacgtcaaatcatcatgccccttatgttcagggctacacacgtgctacaatggccgatacaacgggcagcgaaggagtaatccggagcaaatcctataaagtcggtcccagttcggattgtgggctgaaactcgcccacatgaagctggagttgctagtaatcgcgaatcagaatgtctgcggtgaatgcgttcccgggtcttgtacactaccagcc

SEQ ID NO: 138 - DNA, 1314 bp, Alkaliphilus oremlandii
aataccccatgacgccttttgggggcatccctaaaaggtcaaagaacttcggtacaggatgggcccgcgtctgattagctagttggtgaggtaatggctcaccaaggcgacgatcagtagccggcctgagagggtgaacggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagataatgacggtaccttaggaggaagccccggctaactacgtgccagcagccgcggtaatacgtagggggcaagcgttatccggaatcattgggcgtaaagggtgcgtaggctgccctataggtcagaggtcaaaggctacggctcaaccgtagtaagcctttgaaactgtagggcttgagtgcaggagaggagagtggaattcctagtgtagcggtgaaatgcgtagatattaggaggaacaccagtggcgaaggcgactctctggactgcaactgacgctgaggcacgaaagcgtgggtagcgaacaggattagataccctggtagtccacgccgtaaacgatgagtgctaggtgttgggggtcgaacctcggtgccgaagttaacgcattaagcactccgcctggggagtacgtacgcaagtatgaaactcaaaggaattgacggggacccgcacaagcagcggagcatgtggtttaattcgaagcaacgcgaagaaccttacctggacttgacatccctctgaccgattcttaaccgaatccttcccttcggggacagaggagacaggtggtgcatggttgtcgtcagctcgtgtcgtgggatgttgggttaagtcccgcaacgagcgcaacccttgtctttagttgccatcattaagttgggcactctagagagactgccggggataactcggaggaaggtggggatgacgtcaaatcatcatgccccttatgttcagggctacacacgtgctacaatggccgatacaacgggcagcgaaagagtaatctggagcaaatcctacaaaatcggtcccagttcggattgtgggctgaaactcgcccacatgaagttggagttgctagtaatcgcggatcagaatgtcgcggtgaatgcgttcccgggtcttgtacacaccgcccgtcacaccatgggagttggaagcacccgaagccagctatctaaccgtaaggaggaagctgtcgaaggtgaagctaatgactggggtgaagtcgtaacaaggtagccg

SEQ ID NO: 139 - DNA, 1482 bp, Alloscardovia omnicolens
gacgaacgctggcggcgtgcttaacacatgcaagtcgaacgggatcctttctagcttgctaggggggtgagagtggcgaacgggtgagtaacgcgtgattaacctgccgtgtagtttggaatagctcctggaaacgggtggtaatgccgaatgttccacatgctcgcatgggtgtgtgggaaaacgttttagtgctatgcgatgggatcgcgtcctatcagcttgttggtggggtagtggcctaccaaggcttcgacgggtagccggcctgagagggcgaccggccacattgggactgagatacggcccagactcctacgggaggcagcagtggggaatattgcacaatggggggaaccctgatgcagcgacgccgcgtgcgggatgacggccttcgggttgtaaaccgcttttattggggagcaagcgtgagtgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggattggcgctgggtacgggcaggctagagtgtagtaggggagactggaattctcggtgtaacggtggaatgtgtagatatcgggaagaacaccaatggcgaaggcaggtctctgggctattactgacgctgaggagcgaaagcgtggggagcgaacaggattagataccctggtagtccacgccgtaaacggtggatgctggatgtggggccctttccacgggttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgttaacgatggcctcagagatggggtgtctcttcggagcgttttcacaggtggtgcatggtcgtcgtcagctcgtgtcgtgagatgttgggttaagtcccgcaacgagcgcaacccttgtcttgtgttgccagcacgttatggtgggaactcacaagagaccgccggggttaactcggaggaaggtggggatgacgtcagatcatcatgccccttacgtcttgggcttcacgcatgctacaatggccggtacagcgaggtgcgatagggtgacctggagcggatctctgaaaaccggtctcagttcggatcggagcctgcaactcggctccgtgaaggtggagtcgctagtaatcgcagatcagcaacgctgcggtgaatgcgttcccgggccttgtacacaccgcccgtcaagtcatgaaagtgggcagcacccgaagccggtggcctaacagtttttgctgggggagccgtctaaggtgaggttcgcgattgggactaagtcgtaacaaggtagccgtaccggaagg

SEQ ID NO: 140 - DNA, 1230 bp, Alloscardovia sp. OB7196
cgaacgagtggcgaacgggtgagtaacgcgtgatcaacctgccgtgtagtggggaatagctcctggaaacgggtggtaatgccctatgttgaaaggtgctatgcgatgggatcgcgtcctatcagcttgttggtggggtaatggcctaccaaggcttcgacgggtagccggcctgagagggcgaccggccacattgggactgagatacggcccagactcctacgggaggcagcagtggggaatattgcacaatgggggaaaccctgatgcagcgacgccgcgtgcgggatgacggccttcgggttgtaaaccgcttttaattgggagcatgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggatttgcgctgggtacgggcaggctagagtgtagtaggggagactggaattcccggtgtaacggtggaatgtgtagatatcgggaagaacaccaatggcgaaggcaggtctctgggctaactgacgctgaggagcgaaagcgtggggagcgaacaggattagataccctggtagtccacgccgtaaacggtggatgctggatgtggggcgttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgcacaggtggtgcatggtcgtcgtcagctcgtgtcgtgagatgttgggttaagtcccgcaacgagcgcaacccttgtcttgtgttgccagcacgtgggaactcacaagagaccgccggggttaactcggaggaaggtggggatgacgtcagatcatcatgccccttacgtcttgggcttcacgcatgctacaatggccggcagcgaggtgcgatagggtgacctggagcggatctctgccggtctcagttcggatggagcctgcaactcggctccagaaggtggagtcgctagtaatcgcagatcagcaacgctgcggtgaatgcgttcccgggccttgtacacaccgcccgtcaagtcatgaaagtgggcaacacccgaagccggtgcctagg

SEQ ID NO: 141 - DNA, 1528 bp, Anaerobaculum hydrogeniformans
agagtttgatcctggctcaggacgaacgctggcggcgcgcttaacacatgcaagtcgtgcgatacctcgagcgagtcttacgacaagctcaaggtagagcggcggacgggtgagtaacacgtgagtagctgtcctaaggagggggataacgcctggaaacgggtgctaaaaccccatatgcctcgcaagaggtgaaaatgtagcttgctacagccttagggtgtgctcgcggcctatcagctagttggtgaggtaacggctcaccaaggctaagacgggtagccggcctgagagggtgtacggccacactggaattgagatacggtccagactcctacgggaggcagcagtggggaatcttgggcaatgggcgaaagcctgacccagcgacgccgcgttggggatgaagcccttcggggtgtaaacccatgttgtaggggacgaagaaagtgacggtaccctacgaggaagccccggctaactacgtgccagcagccgcggtaagacgtagggggcaagcgttgtccggaattactgggcgtaaagggcacgcaggcggtgcgccaagtcgagggtgtaaagttacggctcaaccgtgacattgcaatcgatactggcgcgctggagtgcgggagagggaagtggaattcccggtgtagcggtgaaatgcgtagatatcgggaggaacgccagtggcgaaggcggcttcctggcccgcgactgacgctcatgtgcgaaagccaggggagcgaaccggattagatacccgggtagtcctggccgtaaacgatgggtgctaggtgtaggcgcgtcaagcgtctgtgccgcagttaacgcgataagcacctcgcctggggagtacggtcgcaaggctgaaactcaaaggaattgacgggggcccgcacaagcggtggagcacgtggtttaattcgatgcaaaccgaagaaccttacctgggtttgacatgcaggtggtacgaacctgaaagggcgaggaccatatcttcggatgtggagcctgcacaggtgctgcatggctgtcgtcagctcgtgtcgtgagatgttgggttaagtcccgcaacgagcgcaacccctgcgcctagttgccatcagttaggctgggcactctaggcggactgccggcgacaagtcggaggaaggtggggatgacgtcaagtcatcatggcctttaagcccagggcgacacacgtgctacaatggccagcacagagggcggcaagtccgcgagggcaagcgaatcccttaaagctggtcttagttcggatcgcagtctgcaacccgactgcgtgaagccggaatcgctagtaatcgccggtcagccatacggcggtgaatacgttcccgggccttgtacacaccgcccgtcacaccacccgagttgggtgctcccgaagccgccggcccaacccctttttggggagggaggcgtcgaaggagtgtctgataaggggggtgaagtcgtaacaaggtagccgtaccggaaggtgcggctggatcacctcctttct

SEQ ID NO: 142 - DNA, 1468 bp, Anaerobiospirillum succiniciproducens
gctggcggcaggcctaatacatgcaagtcgaacggtaacagcagagagcttgctctttggctgacgagtggcggacgggtgagtaaggcttgggaatctgcctggtagtgggggacaacagttggaaacgactgctaataccgcatactcccttcgggggaaagacttcggttgctatcagatgagcccaagtgggattagctagtaggtgaggtaaaggctcacctaggcgacgatctctagctggtctgagaggatgatcagccacattgggactgagacacggcccagactcctacgggaggcagcagtagggaatattgcacaatgggggaaaccctgatgcagccatgccgcgtgtgtgaagaaggccttcgggttgtaaagcactttcagtggggaggaaacactgacgttacccacagaagaagcaccggctaactccgtgccagcagccgcggtaatacggagggtgcaagcgttaatcggaataactgggcgtaaagggcatgtaggcggaaaggtaagtaggatgtgaaatacccgggctcaacctgggttggtcattctaaactgcctttctagagtattgcagagggagatggaatttcaggtgtagcggtggaatgcgtagatatctgaaagaacaccagaggcgaaggcggtctcctgggcaaatactgacgctgaggtgcgaaagcgtggggagcaaacaggattagataccctggtagtccacgccgtaaacgatgtcgattaggagcttgaacttcggtttgggttccgcagctaacgcgataaatcgaccgcctggggagtacggccgcaaggttaaaactcaaatgaattgacgggggcccgcacaagcggtggagcatgtggtttaattcgaagcaacgcgaagaaccttacctgaccttgacatcgtaggaatctttyagagatragagagtgccttcgggaacctacagacaggtgctgcatggctgtcgtcagctcgtgtcgtgagatgttgggttaagtcccgcaacgagcgcaacccttgtcctttgttgccaacaggtaaagctgggaactcaaaggagactgccggtgacaaaccggaggaaggtagggatgacgtcaagtcatcatggcccttacggtcagggctacacacgtgctacaatggggcgtacagagggaaacgataccgtgaggtggagtggaacccacaaagcgtcccgcagttcggattggagtctgcaactcgactccatgaagtcggaatcgctagtaatcgcaaatcagaatgttgcggtgaatacgttcccgggccttgtacacaccgcccgtcacaccatgggagcggattgcaccagaagtagttagcttaaccgaaaggagggcgattaccacggtgtggtctgtgactggggtgaagtcgtaacaaggtaaccgtaggggaacctgcggttggatcacctcc

SEQ ID NO: 143 - DNA, 1494 bp, Anaerobiospirillum thomasii
cctggctcagattgaacgctggcggcaggcctaatacatgcaagtcgaacggtaacagtaagatagcttgctatcttagctgacgagtggcggacgggtgagtaaagtctgggaaactgcctgatagagggggacaacagctggaaacggctgctaataccgcatacaccctgagggggaaaggagcaatccgctatcagatgtgcccagatgggattagctagtaggtgtggtaagggcgcacctaggcgacgatctctagctggtctgagaggatgatcagccacattgggactgagacacggcccagactcctacgggaggcagcagtagggaatattgcacaatggggggaaccctgatgcagccatgcccgctgtgtgaagaaggccttcgggttgtaaagcactttcagtggggaggaaatcgcaagagtgacgttacccacagaagaagcaccggctaactccgtgccagcagccgcggtaatacggagggtgcaagcgttaatcggaataactgggcgtaaagggcatgtaggcggatagtcaagtaaggtgtgaaagccccgggctcaacctgggaactgcactttaaactaactatctagagtattgcagagggaaatggaattccaggtgtagcggtgaaatgcgtagatatctggaagaacaccagaggcgaaggcgatctcctgggcagatactgacgctgaggtgcgaaagcgtggggagcaaacaggattagataccctggtagtccacgccgtaaacgatgtcgattagaagcttgagcgatagtttgggtttcgtagctaacgcgctaaatcgaccgcctggggagtacggccgcaaggttaaaactcaaatgaattgacgggggcccgcacaagcggtggagcatgtggtttaattcgatgcaacgcgaagaaccttacctgaccttgacatcgtaggaatgaataagagattattcagtgccttcgggagcctatagacaggtgctgcatggctgtcgtcagctcgtgtcgtgagatgttgggttaagtcccgcaacgagcgcaacccttgtcctttgttgccagcgggtaaagccgggaactcaaaggagactgccagtgacaaactggaggaaggcagggatgacgtcaagtcatcatggcccttacggtcagggctacacacgtgctacaatggggcgtacagagggagacgaaaccgcgaggtggagtggagcccacaaagcgtcccgcagttcggattggagtctgcaactcgactccatgaagtcggaatcgctagtaatcgcaaatcagaatgttgcggtgaatacgtccccgggccttgtacacaccgcccgtcacaccatgggagtgaattgcaccagaagtagttagcctaaccgcaaggagggcgattaccacggtgtggtttatgactggggtgaagtcgtaacaaggtaaccataggggaacctgtggctggatcacctcct

SEQ ID NO: 144 - DNA, 1530 bp, Anaerococcus hydrogenalis
tttaattgagagtttgatcctggctcaggataaacgctggcggcgtgcataacacatgcaagtcgaacgatgaaacttagatgatttcttcggaatgaacttaagtggattagtggcgaacgggtgagtaacacgtgagtaacctgccttacacaaggggatagcctctggaaacggagaataataccctataaagtctaatcagcccatgctggaaagaccaaagatttatcggtgtaagatggacttgcgtctgattagctagttggtgagataaaagctcaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttacgggatgaaaatgacagtaccgtaagaataaggtccggctaaatacgtgccagcagccgcggtaatacgtatggaccgagcgttgtccggaatcattgggcgtaaagggtacgtaggcggcctagtaagttagaagttaaagaatatagctcaactatataaagcttttaaaactgctaggcttgagagatggaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatatttcggagggaattagagataattccttacgacttcggtcgactgaaatacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagtgatctgaagcgaaactcacaaaatctgtcccagttcggattgtactctgcaactcgagtacatgaagttggagttgctagtaatcgcgaatcagaatgtcgcggtgaatgcgttcccgggtcttgtacacaccgcccgtcacaccatggaagttggcaatacccgaagcctgtgagcgaaccttttaggacgcagcagtcgaaggtagggtcagtaactggggtgaagtcgtaacaaggtagccgtatcggaaggtgcggctggatcacctcctttct

SEQ ID NO: 145 - DNA, 1426 bp, Anaerococcus lactolyticus
tggattagtggcggacgggtgagtaacgcgtgagtaacctgccttagagaaggggatagcctttggaaacgaagaataataccctataacaccaacacctcgcatgaagagttggtcaaagatttatcgctctaagatggacttgcgtctgattagttagttggtgaggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctgtagctcaactacagtaagcttttaaaactgctcatcttgagatatggaagggaaagtggaattcctagtgtagcggtgaaatgcgcagatattaggaggaataccggtggcgaaggcgactttctggccataatctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcgcgcaagcgtgaaactcaaaggaattgacggggacccgcacaagcagcggagcatgtggtttaattcgacgcaacgcgaagaaccttaccaagtcttgacatattacggcgggagctagagatagttccttacttcttcggaagactgtaatacaggtggtgcatggttgtcgtcagctcgtgtcgtgagatgttgggttaagtcccataacgagcgcaacccctatcgttagttaccatcattaagttggggactctaacaatactgccggtgacaaaccggaggaaggtggggatgacgtcaaatcatcatgccctttatgacttgggctacacacgtgctacaatggcaggtacacagagcagctaaacagcgatgtcacgcgaatctcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagcgaacccttgtggacgcagcagtcgaaggtagggtcagtaactggggtgaagtcgtaacaaggtagccgtatcggaaggtgcggctggatcacctcctttct

SEQ ID NO: 146 - DNA, 1407 bp, Anaerococcus octavius
gattaacgctggcggcgtgcataacacatgcaagtcgaacgatgaaacttaaatgatttcttcggaatgaacttaagtggattagtggcggacgggtgagtaacgcgtgagtaacctgccttacacaaggggatagccgttggaaacgacgaataataccctatgaaactatcacttcgcatgaagcgatagtcaaagtgttagcggtgtaagatggacttgcgtctgattagctagttggtgagaaaaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcgggtcattaagttagaagtcaaaggctatagctcaactatagtaagcttctaaaactggagaccttgagtaatggaagggaaagtggaattcctagtgtagcggtggaatgcgcagatattaggaggaataccggtggcgaaggcgactttctggccattaactgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaagaaccttaccaagtcttgacatattttggaagcacttagagataagtgcctatatcttcggataactgaaatacaggtggtgcatggttgtcgtcagctcgtgtcgtgagatgttgggttaagtcccataacgagcgcaacccctatggctagttaccatcattaagttggggactctagcaatactgccggtgacaaaccggaggaaggtggggatgacgtcaaatcatcatgccctttatgacttgggctacacacgtgctacaatggcaggtacagagggcagcaagacagcgatgttaagcaaaactcaaaaagcctgtcccagttcggattgcactctgcaactcgagtgcatgaagttggagttgctagtaatcgtggatcagaatgccacggtgaatgcgttcccgggtcttgtacacaccgcccgtcacaccatggaagttggcaatacccgaagcctgtgagcgaacc

SEQ ID NO: 147 - DNA, 1521 bp, Anaerococcus prevotii
agagtttgatcctggctcaggataaacgctggcggcgtgcataacacatgcaagtcgaacgatgaagcttaaatgatctcttcggagtgaccttaagtggattagtggcggacgggtgagtaacgcgtgagtaacctgccttgcacaaggggatagccgttggaaacgacgaataataccctatgatatgatagcctcgcatgaagctatcatcaaagatttatcggtgtaagatggactcgcgtctgattagctagttggtggggtaacagctcaccaaggcaacgatcagtagccggcttgagagagtgtacggccacattgggactgagacacggcccagactcctacgggaggcagcagtggggaattttgcacaatgggggcaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgctcatcttgaggtatggaagggaaagtggaattcctagtgtagcggtgaaatgcgcagatattaggaggaataccagtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggcggggtctagagatagactcttacttcttcggaagactgtaatacaggtggtgcatggttgtcgtcagctcgtgtcgtgagatgttgggttaagtcccataacgagcgcaacccctattgttagttaccatcattaagttggggactctagcaatactgccggtgacaaaccggaggaaggtggggatgacgtcaaatcatcatgccctttatgacttgggctacacacgtgctacaatggcaggtacagagggaagcgagactgcgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagctaacctttagggagcagcagtcgaaggtagggtcagtaactggggtgaagtcgtaacaaggtagccgtatcggaaggtgcggctggatcacctcctttct

SEQ ID NO: 148 - DNA, 1492 bp, Anaerococcus sp. 8404299
agagtttgatcctggctcaggataaacgctggcggcgtgcataacacatgcaagtcgaacgatgaaccttaattgatttcttcggaatgaaattaagctggattagtggcgaacgggtgagtaacacgtgagtaacctgccttacacaaggggatagcctttggaaacgaagaataataccctataaagtcaaacaatatcgcatgctaragtgaccaaagatttatcggtgtaagatggacttgcgtctgattagctagttggtgagataaaagcccaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcctagtaagttagaagtgaaataatatagctcaactatataaagcttttaaaactgttaggcttgagagatgaaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagataatttcttatcacttcggtgaactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagcgatctgaagcgaaactcacaaagtctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaaccaattggacgcagcagtcgaaggtagggtcagtaactggggtgaagtcgtaacaaggtagccgt

SEQ ID NO: 149 - DNA, 1486 bp, Anaerococcus sp. 8405254
tagagtttgatcctggctcaggattaacgctggcggcgtgcataacacatgcaagtcgaacgatgaaactttaatgaacccttcggggagaattaaagcggattagtggcgaacgggtgagtaacgcgtgagtaacctgccttacacaaggggatagcctttggaaacgaagaataataccctataaaaccataaaggcacatgcaattatggtcaaagtattagcggtgtaagatggacttgcgtctgattagctagttggtgagataaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcggctagaaaagttagaagtcaaaggctatagctcaactatagtaagcttctaaaactatttagcttgagagatggaagggaaagtggaattcctagtgtagcggtggaatgcgcagatattaggaggaataccggtggcgaaggcgactttctggccattttctgacgctgaggtacgaaagcgtgggtagcaaacaggattagataccctggtagtccacgccgtaaacgatgagtgttaggtgtctggagtcaaatctgggtgccgcagcaaacgcattaaacactccgcctggggagtacgcacgcaagtgtgaaactcaaaggaattgacggggacccgcacaagcagcggagcatgtggtttaattcgacgcaacgcgaagaaccttaccaagtcttgacatattttagaagcaattagagataattgcctatatcttcggataactaaaatacaggtggtgcatggttgtcgtcagctcgtgtcgtgagatgttgggttaagtcccataacgagcgcaacccctattgctagttaccatcattaagttggggactctagtaatactgccggtgacaaaccggaggaaggtggggatgacgtcaaatcatcatgccctttatgacttgggctacacacgtgctacaatggcaggtacacagggaagcaagactgtgaagttaagcaaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccctttggggcgcagcagtcgaaggtagggtcagtaactggggtgaagtcgtaacaagg

SEQ ID NO: 150 - DNA, 1435 bp, Anaerococcus sp. 9401487
tagagtttgatcctggctcaggattaacgctggcggcgtgcataacacatgcaagtcgaacgatgaaacttaaaagatttcttcggaatgaccttaagtggattagtggcggacgggtgagtaacgcgtgagtaacctgccttacacaaggggatagcctctggaaacggagaataataccctataacaccatcaaatcgcatgaagtgatggtcaaagtgttagcggtgtaagatggacttgcgtctgattagctagttggtgagaaaaaagcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaattacgtgccagcagccgcggtaatacgtaaggaccgagcgttgtccggaatcattgggcgtaaagggtacgtaggcgggtttttaagttagaagtcaaaggctatagctcaactatagtaagcttctaaaactgggaaccttgagagatggaagggaaagtggaattcctagtgtagcggtggaatgcgcagatattaggaggaataccggtggcgaaggcgactttctggccattttctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaagaaccttaccaagtcttgacatattacggcagggattagagataatcccctacatcttcggatgactgtaatacaggtggtgcatggttgtcgtcagctcgtgtcgtgagatgttgggttaagtcccataacgagcgcaaccccttttgctagttaccatcattaagttggggactctagcaatactgccggtgacaaaccggaggaaggtggggatgacgtcaaatcatcatgccctttatgacttgggctacacacgtgctacaatggcaggtacacagggcagcaagacagtgatgttaagcgaaactcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagctaaccctttggg

SEQ ID NO: 151 - DNA, 1289 bp, Anaerococcus sp. 9403502
aagtaatcaaagtgttttagcggtgtaagatggacttgcgtctgattagctagttggtgagataacagctcaccaaggcaacgatcagtagccggcttgagagagtgtacggccacattgggactgagacacggcccagactcctacgggaggcagcagtggggaattttgcacaatgggggcaaccctgatgcagcgacgccgcgtgatttatgaaggccttcgggttgtaaaaatcttttgtataggaagaagatgacagtactatacgaataaggtccggctaattacgtgccagcagccgcggtaatacgtaaggaccgagcgttgtccggaatcattgggcgtaaagggtacgtaggcggccamttaagttagaagtcaaaggctatagctcaactatagtaagcttctaaaactgggtggcttgagagatggaagggaaagtggaattcctagtgtagcggtgaaatgcgcagatattaggaggaataccggtggcgaaggcgactttctggccattatctgacgctgaggtacgaaagcgtgggtagcaaacaggattagataccctggtagtccacgccgtaaacgatgagtgttaggtgtctggagtaaatctgggtgccgcagctaacgcattaaacactccgcctggggagtacgcacgcaagtgtgaaactcaaaggaattgacggggacccgcacaagcagcggagcatgtggtttaattcgaagcaacgcgaaaaaccttaccaagtcttgacatattacggcgtttcttagagataagaagctatatcttcggataactgtaatacaggtggtgcatggttgtcgtcagctcgtgtcgtgagatgttgggttaagtcccataacgagcgcaacccttatggctagttaccatcattaagttggggactctagcaatactgccggtgacaaaccggaggaaggtggggatgacgtcaaatcatcatgccctttatgacttgggctacacacgtgctacaatggcaggtacagagggcagcgaaactgygaagttaagcgaaactcaaaaagcctgtcccagttcggattgcactctgcaactcgagtgcatgaagttggagttgctagtaatcgcagatcagaatgctgcggtgaatgcgttcccgggtcttgtacacaccgcccgtcacaccatggaagttggcaatacccgaagcctgtgagcgaaccctttgggacgcagcagtcgaaggtagggtcagtaactggggtgaagtcgtaacaaggtagccgta

SEQ ID NO: 152 - DNA, 1445 bp, Anaerococcus sp. gpac104
gattaacgctggcggcgtgcataacacatgcaagtggaacgatgaaacttgaatgatctcttcggagtgaacttaagtggattagtggcggacgggtgagtaacgcgtgagtaacctgccttagagaaggggatagcctttggaaacgaagaataataccctatgacatgatagcctcgcatgagattatcrtcaaagatttatcgctctaagatggacttgcgtctgattagttagttggtggggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaacatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggaattcctagtgtagcggtgaaatgcgcagatattaggaggataccggtggcgaaggcgactttctggcataacctgacgctgaggtacgaaagcgtgggtagcaaacaggattagataccctggtagtccacgccgtaaacgatgagtgttaggtgtctggagtaaatctgggtgccgcagtaacgcattaaacactccgcctggggagtacgcgcgcaagcgtgaaactcaaaggaattgacgggacccgcacaagcagcggagcatgtggtttaattcgacgcaacgcgaagaaccttaccaagtcttgacatattacggcgggagctagagatagttccttacttcttcggaagactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgacttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttcccgggtcttgtacacaccgcccgtcacaccatggaagttggcaatgcccgaagcctgtgagcgaacccttgtgggcgcagcagtcgaaggtagggtcagtaactgggtg

SEQ ID NO: 153 - DNA, 1450 bp, Anaerococcus sp. gpac126
  modified_base (842)..(842): a, c, t, g, unknown or other
gattaacgctggcggcgtgcataacacatgcaagtcgaacgatgaaagctaaatgatttcttcggaatgaatttagccggattagtggcggacgggtgagtaacgcgtgagtaacctgccttagagaaggggatagcctttggaaacgaagaataataccctatgacaccaacacctcgcatgaagagttggtcaaagatttatcgctctaagatggacttgcgtctgattagttagttggtgaggtaacggctcaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggattcctagtgtagcggtgaaatgcgcagatattaggggggataccggtggcgaaggcgactttctggcataacctgacgctgaggtacgaaagcgtgggtagcaaacagggttagataccyggkagtccacgccgtaaacgawgagtgataggtgtctggagaaaatctgggtgccgcagtaacgcatwaaacactccsccctggggantacgcgcgcaagcgtgaaactcaaaggaattgacggggacccgcacaagcagcggagcatgtggtttaattcgacgcaacgcgaagaacctttaccaagtctagacatattaccggcgggatctagagatagatccctacttcttcggaagactgtaatacaggtggtgcatgtttgtcgtcagctcgtgtcgtgagatgttgggttaagtcccataagcgagcgcaacccctattgttagttaccatcattaagttggggactctaacgatactgccgttgacaaaccggagaaagttggggacgacgtcaaatcatcatgccctttatgacttgggctacacacgtgctacaatggcaggtacacagagcagctagacagcgatgtcatgcaaatctcaaaaagcctgtccccagttcggattgtactctgcaactcgagtacatgaagttggagttgctagtaatcgtggatcagaatgccgcggtgaatgcgttcccgggtcttgtacacaccgcccgtcacaccatggaagttggcaatacccgaagcctgtgagcgaacccttgtggaagcagcagtcgaaggtagggtcagtaactgggtg

SEQ ID NO: 154 - DNA, 1440 bp, Anaerococcus sp. gpac155
  modified_base (1373)..(1373): a, c, t, g, unknown or other
  modified_base (1395)..(1397): a, c, t, g, unknown or other
  modified_base (1401)..(1401): a, c, t, g, unknown or other
gattaacgctggcggcgttcataacacatgcaagtcgaacgatgaaacttaaatgatctcttcggagtgaatttaagtggattagtggcggacgggtgagtaacgcgtgagtaacctgccttagagaaggggatagcctttggaaacgaagaataataccctatgaaaccataacctcgcatgaggccttggtcaaagatttatcgctctaagatggacttgcgtctgattagttagttggtggggtaacggcccaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttctatgggaagaaaatgacagtaccataggaataaggaccggctaattacgtgccagcagccgcggtaatacgtaaggtccgagcgttgtccggaatcattgggcgtaaagggtacgtaggcgggtaagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataccctgacgctgaggtacgaaagcgtgggtagcaaaccaggattagataccctggtagtccacgccgtaaacgatgagtgttaggtgtctggagtaaatctgggtgccgcagctaacgcattaaacactccgccctggggagtacgcgcgcaagcgtgaaactcaaaggaattgacggggacccgcacaagcagcggagcatgtggtttaattcgacgcaacgcgaagaaccttaccaagtcttgacatattacggcggaacttagagataagttcttatgacttcggtcaactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgacttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttcccggtcttgtacacacgccgtcacaccatgnagttgcatacccgagcctgtgnnncccngtgggcgccgcagtcgaaggtaggtcagtaactggggtg

SEQ ID NO: 155 - DNA, 1457 bp, Anaerococcus sp. gpac199
gattaacgctggcggcgtgcataacacatgcaagtggaacgatgaaacttttttgatttcttcggaatgaatataagtggattagtggcggacgggtgagtaacgcgtgagtaacctgccttagagaaggggatagcctttggaaacgaagaataataccctatgaaaccataacctcgcatgaggccttggtcaaagatttatcgctctaagatggacttgcgtctgattagttagttggtggggtaacggcctaccaagacagcgatcagtagccggcttgagagagtgtacggccacattgggactgagacacggcccagactcctacgggaggcagcagtggggaattttgcacaatgggggaaaccctgatgcagcgacgccgcgtgatttagaaggccttcggggttgtaaaaatcttttctatgggaagaaaatgacagtaccatagggaataagggaccgggctaattacgtgccagcagccgcgggtaatacgtaaggtccgcagcgttgtccggaatcattgggcgtaaagggtacgtaggcgggtaagcaagttagaagtgaaatcctatagctcaactatagtaagcttttaaaactgctcatcttgaggtatggaagggaaagtgggattcctagtgtagcggtgaaatgcgcagatattaggaggataccgggtggcgaaggcgactttctgccaataccctgacgctgaggtacgaaagcgtggtagcaaaccaggattagataccctggtagtccacgccgtaaacgatgagtgttaggtgtctggagtaaatctgggtgccgcagctaacgcattaaacactccgcctggggagtacgcgcgcaagcgtgaaactcaaaggaattgacggggacccgcacaagcagcggagcatgtgtttaattcgacgcaacgcgaagaaccttaccaagtcttgacatattacggcggaacttagagataagttcttatgacttcggtcaactgtaatacaggtggtgcatggttgtcgtcagctcgtgtcgtgagatgttgggttaagtcccataacgagcgcaacccctattgttagttaccatcattaagttggggactctaacgatactgccggtgacaaaccggaggaaggtggggacgacgtcaaatcatcatgccctttatgatcttgggctacacacgtgctacaatggcaggtacacagagcagctaaacagtgatgtcttgcgaatctcaaaaagcctgtcccagttcggattgtactctgcaactcgagtacatgaagttggagttgctagtaatcgtgaatcagaatgtcgcggtgaatgcgttccccgggtcttgtacacaccgcccgtcacaccatggaagttggcaatacccgaagccctgtgagcgaacccaattgggcgcagcagtcgaaggtaggtcagtaactggggtg

SEQ ID NO: 156 - DNA, 1458 bp, Anaerococcus sp. gpac215
  modified_base (13)..(13): a, c, t, g, unknown or other
  modified_base (737)..(737): a, c, t, g, unknown or other
  modified_base (741)..(741): a, c, t, g, unknown or other
  modified_base (761)..(761): a, c, t, g, unknown or other
taacgctggcggncgtgcataacacatgcaagtcgaacgatgaaacttaaatgatttcttcggaatgaacttaagcggattagtggcgaacgggtgagtaacacgtgagtaacctgccttacacaaggggatagcctttggaaacgaagaataataccctataacgtcaaattatcgcatgatagaatgaccaaagatttatcggtgtaagatggacttgcgtctgattagctagttggtgagataaaggcccaccaaggcaacgatcagtagccggctttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcccagtaagttagaagtgaaataatatagctcaactatataaagcttttaaaactgctaggcttgagagatggaagggaaagtggaattcctagtgtagcggtgaaatgcgcagatattaggaagaataccggtgccgaagcgactttctggtcatcatctggacgttgaggtacgaaagcgttggttancaanccaggattagatacccctgntagtccacggcctgtaaacgatgagtgttagttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagatagtttcttaagacttcggtctactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcaatgccccttttaatggaaccttgggctacacacgtgctacaatggcaggtacagagggcagcgaaagagcgatctgaagcgaaactcaaaaaacctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaccttttaggacgcagcagtcgaaggtaggatcagtaagctgggtg

SEQ ID NO: 157 - DNA, 1530 bp, Anaerococcus tetradius
ttatatatgagagtttgatcctggctcaggattaacgctggcggcgtgcataacacatgcaagtcgaacgatgaagatatttagattccttcgggatgaaaaatattggattagtggcggacgggtgagtaacgcgtgagtaacctgccttacacaaggggatagccgttggaaacgacgaataataccctatgacataaactcttcgcatgaagagcttatcaaagatttatcggtgtaagatggactcgcgtctgattagctagttggtgaggtaacggcccaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtatgggaagaaaatgacagtaccatacgaataaggaccggctaattacgtgccagcagccgcggtaatacgtaaggtccgagcgttgtccggaatcattgggcgtaaagggtacgtaggcggataagcaagttagaagtgaaatcctatagctcaactatagtaagcttttaaaactgctcatcttgaggtatggaagggaaagtggaattcctagtgtagcggtgaaatgcgcagatattaggaggaataccggtggcgaaggcgactttctggccataaactgacgctgaggtacgaaagcgtgggtagcaaacaggattagataccctggtagtccacgccgtaaacgatgagtgttaggtgtctggaataatctgggtgccgcagctaacgcaataaacactccgcctggggagtacgcacgcaagtgtgaaactcaaaggaattgacggggacccgcacaagcagcggagcatgtggtttaattcgacgcaacgcgaagaaccttaccaagtcttgacatattacggagggaattagagatagttccttacttcttcggaagactgtaatacaggtggtgcatggttgtcgtcagctcgtgtcgtgagatgttgggttaagtcccataacgagcgcaacccctatatttagttaccatcattaagttggggactctagatatactgccggtgataaaccggaggaaggtggggatgacgtcaaatcatcatgccctttatgacttgggctacacacgtgctacaatggcaggtacacagggaagcgagactgcgaagttaagcaaaactcaaaaagcctgtcccagttcggattgcactctgcaactcgagtgcatgaagttggagttgctagtaatcgtggatcagaatgccgcggtgaatgcgttcccgggtcttgtacacaccgcccgtcacaccatggaagttggcaatacccgaagcctgtgagctaaccattaggaagcagcagtcgaaggtagggtcagtaactggggtgaagtcgtaacaaggtagccgtatcggaaggtgcggctggatcacctcctttct

SEQ ID NO: 158 - DNA, 1425 bp, Anaerococcus vaginalis
tggattagtggcgaacgggtgagtaacacgtgagtaacctgccttacacaaggggatagcctttggaaacgaagaataataccctataaagtcaaaatatcgcatgataaaatgaccaaagatttatcggtgtaagatggacttgcgtctgattagctagttggtgagataaaagcccaccaaggcgacgatcagtagccggcttgagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttatgggatgaaaatgacagtaccataagaataaggtccggctaaatacgtgccagcagccgcggtaatacgtatggaccgagcgttgtccggaatcattgggcgtaaagggtacgtaggcggcctagtaagttagaagtgaaataatatagctcaactatataaagcttttaaaactgttaggcttgagagatgaaagggaaagtggaattcctagtgtagcggtgaaatgcgcagatattaggaagaataccggtggcgaaggcgactttctggtcatcatctgacgctgaggtacgaaagcgtgggtagcaaacaggattagataccctggtagtccacgctgtaaacgatgagtgttaggttcttggaataatctgggagccgcagctaacgcattaaacactccgcctggggagtacgcacgcaagtgtgaaactcaaaggaattgacggggacccgcacaagcagcggagcatgtggtttaattcgacgcaacgcgaagaaccttaccaagtcttgacataatacggagggaattagagataattttctatgacttcggtctactgtattacaggtggtgcatggttgtcgtcagctcgtgtcgtgagatgttgggttaagtcccataacgagcgcaacccctatcgttagttaccatcattaagttggggactctagcgatactgccggtgataaaccggaggaaggtggggacgacgtcaaatcatcatgccctttatgacttgggctacacacgtgctacaatggcagatacagagggcagcgaaagagcgatctgaagcgaaactcacaaagtctgtcccagttcggattgtactctgcaactcgagtacatgaagttggagttgctagtaatcgcgaatcagaatgtcgcggtgaatgcgttcccgggtcttgtacacaccgcccgtcacaccatgggagttggcaatacccgaagcctgtgagcgaaccttttaggacgcagcagtcgaaggtagggtcagtaactggggtgaagtcgtaacaaggtagccgtatcggaaggtgcggctggatcacctcctttct

SEQ ID NO: 159 - DNA, 1035 bp, Anaerofustis stercorihominis
  modified_base (868)..(868): a, c, t, g, unknown or other
  modified_base (940)..(941): a, c, t, g, unknown or other
  modified_base (956)..(956): a, c, t, g, unknown or other
  modified_base (1004)..(1004): a, c, t, g, unknown or other
  modified_base (1020)..(1021): a, c, t, g, unknown or other
gtcgaacgagaagcttacaattgatccttcgggtgaagctgtaagtggacagtggcgaacgggtgagtaacgcgtaggtaaccaacctcatgcagggggatagcccagggaaacttggattaaacccgcataagaccacagcaccgcatggtgcagaggtaaaaactccggtggcatgagacggacctgcgtcttattaggtagttggtgaggtaacggctcaccaagccaacgatgagtagccgacctgagagggtgatcggccacattgggactgagacacggcccagactcctacgggaggcagcagtggggaatattgcgcaatggggggaaccctgacgcagcaacgccgcgtgagcgatgaaggttttcggatcgtaaagctctgtctttggggaagataatgacggtacccaaggaggaagctccggctaactacgtgccagcagccgcggtaatacgtagggagcaagcgttgtccggattcactgggcgtaaagagcacgtaggcggttaattaagtcaggtgtgaaagttttcggctcaaccggaaaagtgcacttgaaactgaataacttgagtatcggagaggtaagcggaattcctagtgtagcggtgaaatgcgtagagattaggaagaacaccggtggcgaaggcggcttactggacgataactgacgctgaggtgcgaaagcgtggggagcgaacaggattagataccctggtagtccacgccgtaaacgatgaatactaggtgttggggtaactcagtgccgcagttaacacattaagtattccgcctggggagtacgctcgcaagagtgaaactcaaaggaattgacgggggcccgcacaagcagcggancatgtggtttaattcgaagcaacgcgaagaaccttaccaggtcttgacatcccttgaccgcctaagagattnnctttccttcgggacnaggagacaggtggtgcatggttgtcgtcagctcgtgtcgtgagatgtngggttaagtcccgcannagcgcaacccttat

SEQ ID NO: 160 - DNA, 1316 bp, Anaeroglobus geminatus
agagtttgatcctggctcaggacaacgctggcggcgtgcgtaacacatgcaagtcgaacgagagagtgagagaagcttgcttttcttacaatcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgtgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagagggagccggcatgacggtaccgtaagagaaagccacggctaactacgtgccagcagccgcggtaatacgtaggtggcaagcgttgtccggaatgattgggcgtaaagggcgcttggcggctgtgtaagtctgtctagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagatacctggttcttcttcggaagacgagacaacaggtggtgcacggctgtcgtcagctcgtgtcgtgagatgttgggttaagtcccgcaacgagcgcaacccctatcttcagttaccagcacgtagaggtggggactcaggagagactgccgcagacaatgcggaggaaggcggggacgacgtcaagtcatcatgccccttatggcttgggctacacacgtactacaatggctctaaatagagggaagcgaaggagcgatccggagcaaaccccgcaaacagagtccc

SEQ ID NO: 161 - DNA, 1390 bp, Anaerosporobacter mobilis
ggcggcgtgcttaacacatgcaagtcgaacgaagcaactatcttgcttgcaagagagttgacttagtggcggacgggtgagtaacgcgtgggtaacctgcctcatacagggggataacagttggaaacgactgctaagaccgcataacccgctagtgtcgcatgacacggacggaaaatatttataggtatgagatgggcccgcgtctgattagctagttggtaaggtaacggcttaccaaggcgacgatcagtagccgacttgagagagtgatcggccacattgggactgagacacggcccaaactcctacgggaggcagcagtggggaatattggacaatgggggaaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggcatggcaagtcagaagtgaaagcccagggctcaaccctgggactgcttttgaaactgtcaagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtctgggattcgattctcaggtgccgacgctaacgcattaagtattccacctggggagtacgttcgcaagaatgaaactcaaaggaattgacggggacccgcacaagcggtggagcatgtggtttaattcgaagcaacgcgaagaaccttacctagtcttgacatcccgatgaccggactttaatcggtccttctcttcggagcatcggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggatgacgtcaaatcatcatgccccttatgactagggctacacacgtgctacaatggtgataacaaagtgaagcagcctcgtgagagtgagcaaatcacaaaaatgtcatctcagttcggattgtagtctgcaactcgactacatgaagctggaatcgctagtaatcgcgaatcagaatgtcgcggtgaatacgttcccgggtcttgtacacaccgcccgtcacaccatgggagttggtaatgcccgaagtcagtgacccaacc

SEQ ID NO: 162 - DNA, 1539 bp, Anaerostipes caccae
ttgaacatgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacaggggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgagcgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttct

SEQ ID NO: 163 - DNA, 1344 bp, Anaerostipes sp. 3_2_56FAA
  modified_base (25)..(25): a, c, t, g, unknown or other
  modified_base (44)..(44): a, c, t, g, unknown or other
cggatggatttcctatatgactgantggcggacgggtgagtaangcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgcagcccggtaacgggggcaagcgttatcggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcattacggatgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaa

SEQ ID NO: 164 - DNA, 1360 bp, Anaerotruncus colihominis
cttacgttttgaagttttcggatggatgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagcgcggtaatacgtagggagcaagcgttgtccggaattactgggtgtaaagggagcgtaggcgggatggcaagtagaatgttaaatccatcggtcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagaaaggtggtgcatgagtgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccg

SEQ ID NO: 165 - DNA, 1505 bp, Anaplasma marginale
tcaaacttgagagtttgatcctggctcagaacgaacgctggcggcaagcttaacacatgcaagtcgaacggaccgtatacgcagcttgctgcgtgtatggttagtggcagacgggtgagtaatgcataggaatctacctagtagtatgggatagccactagaaatggtgggtaatactgtataatccctgcgggggaaagatttatcgctattagatgagcctatgtcagattagctagttggtggggtaatggcctaccaaggcggtgatctgtagctggtctgagaggatgatcagccacactggaactgagacacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggtttggtaagttaaaggtgaaataccagggcttaaccctggggctgcttttaatactgcaggactagagtccggaagaggatagcggaattcctagtgtagaggtgaaattcgtagatattaggaggaacaccagtggcgaaggcggctgtctggtccggtactgacgctgaggtgcgaaagcgtggggagcaaacaggattagataccctggtagtccacgctgtaaacgatgagtgctgaatgtgggggcttttgcctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccacttcttgacatggaggctagatccttcttaacagaagggcgcagttcggctgggcctcgcacaggtgctgcatggctgtcgtcagctcgtgtcgtgagatgttgggttaagtcccgcaacgagcgcaaccctcatccttagttaccagcgggtaatgccgggcactttaaggaaactgccagtgataaactggaggaaggtggggatgatgtcaagtcagcacggcccttatggggtgggctacacacgtgctacaatggcgactacaataggttgcaacgtcgcaaggctgagctaatccgtaaaagtcgtctcagttcggattgtcctctgtaactcgagggcatgaagtcggaatcgctagtaatcgtggatcagcatgccacggtgaatacgttctcgggtcttgtacacactgcccgtcacgccatgggaattggcttaactcgaagctggtgcgccaaccgtaaggaggcagccatttaaggttgggtcggtgactggggtgaagtcgtaacaaggtagctgtaggtgaacctgcggctggattacctccttt

SEQ ID NO: 166 - DNA, 1508 bp, Anaplasma phagocytophilum
tcaaacttgagagtttgatcctggctcagaacgaacgctggcggcaagcttaacacatgcaagtcgaacggattattctttatagcttgctataaagaatagttagtggcagacgggtgagtaatgcataggaatctacctagtagtatgggatagccactagaaatggtgggtaatactgtataatccctgcgggggaaagatttatcgctattagatgagcctatgttagattagctagttggtagggtaaaggcctaccaaggcgatgatctatagctggtctgagaggatgatcagccacactggaactgagatacggtccagactcctacgggaggcagcagtggggaatattggacaatgggcgcaagcctgatccagctatgccgcgtgagtgaggaaggccttagggttgtaaaactctttcagtagggaagataatgacggtacctacagaagaagtcccggcaaactccgtgccagcagccgcggtaatacggagggggcaagcgttgttcggaattattgggcgtaaagggcatgtaggcggttcggtaagttaaaggtgaaatgccagggcttaaccctggagctgcttttaatactgccagactagagtccgggagaggatagcggaattcctagtgtagaggtgaaattcgtagatattaggaggaacaccagtggcgaaggcggctatctggtccggtactgacgctgaggtgcgaaagcgtggggagcaaacaggattagataccctggtagtccacgctgtaaacgatgagtgctgaatgtggggattttttatctctgtgttgtagctaacgcgttaagcactccgcctggggactacggtcgcaagactaaaactcaaaggaattgacggggacccgcacaagcggtggagcatgtggtttaattcgatgcaacgcgaaaaaccttaccactccttgacatggagattagatccttcttaacggaagggcgcagttcggctggatctcgcacaggtgctgcatggctgtcgtcagctcgtgtcgtgagatgttgggttaagtcccgcaacgagcgtaaccctcatccttagttgccagcgggttaagccgggcactttaaggaaactgccagtggtaaactggaggaaggtggggatgatgtcaagtcagcacggcccttatggggtgggctacacacgtgctacaatggtgactacaataggttgcaatgtcgcaaggctgagctaatccgtaaaagtcatctcagttcggattgtcctctgcaactcgagggcatgaagtcggaatcgctagtaatcgtggatcagcatgccacggtgaatacgttctcgggtcttgtacacactgcccgtcacgccatgggaattggcttaactcgaagctggtgcgccaaccgaaaggaggcagccatttaaggttgggtcagtgactagggtgaagtcgtaacaaggtagctgtaggtgaacctgcggctggattacctccttt

SEQ ID NO: 167 - DNA, 1393 bp, Aneurinibacillus aneurinilyticus
gtcgagcggaccaaagaagagcttgctcttcggcggttagcggcggacgggtgagtaacacgtaggcaacctgcctgtacgactgggataactccgggaaaccggagctaataccggatacgtttttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggtcaaccgtggagggccacttgaaactgggaggcttgagtgcaggagaggagagcggaattccacgtgtagcggtgaaatgcgtagagatgtggaggaacacccgtggcgaaggcggctctctggcctgtaactgacgctgagcgcgaaagcgtggggagcgaacaggattagataccctggtagtccacgccgtaaacgttgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgaccctcctagagataggagctctcttcggagcagcggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgcgccaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagc

SEQ ID NO: 168 - DNA, 1417 bp, Aneurinibacillus danicus
  modified_base (809)..(809): a, c, t, g, unknown or other
  modified_base (1245)..(1245): a, c, t, g, unknown or other
cgaacgctggcggcgtgcctaatacatgcaagtcgagcggaccaacggagagcttgctctcctgcggtcagcggcggacgggtgagtaacacgtaggcaacctgcctgtacgaccgggataactccgggaaaccggagctaataccggataggatttcagaccgcatggtttggaatggaaagaccctgtgtcacgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaaccgccgggataacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccacttgaaactgggaggcttgagtgcaggagaggagagcggaattccacgtgtagcggtgaaatgcgtagagatgtggaggaacacctgtggcgaaggcggctctctggcctgtaactgacgctgaggcgcgaaagcgtggggagcgaacaggattagataccctggtagtccacgccgtaaacgatgagtgctaggtgttggggtntccaaacctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgacccctctagagatagaggcttccttcgggacagcggtgacaggtggtgcatggttgtcgtcagctcgtgtcgtgagatgttgggttaagtcccgcaacgagcgcaacccttgtccttagttgccagcattcagttgggcactctagggagactgccgtcgacaagacggaggaaggtggggatgacgtcaaatcatcatgccccttatgtcctgggctacacacgtgctacaatggatggaacaacgggcagccaactcgcgagagtgagcnaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaacct

SEQ ID NO: 169 - DNA, 1483 bp, Aneurinibacillus migulanus
aggacgaacgctggcggcgtgcctaatacatgcaagtcgagcggaccaatgaagagcttgctcttcggcggttagcggcggacgggtgagtaacacgtaggcaacctgcctgtacgactgggataactccgggaaaccggagctaataccggatacttctttcagaccgcatggtctgaaagagaaagacctttggtcacgtacagatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaaccgccgggatgacctcccggtctgacggtacctaacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccacttgaaactgggaagcttgagtgcaggagaggagagcggaattccacgtgtagcggtgaaatgcgtagagatgtggaggaacacccgtggcgaaggcggctctctggcctgtaactgacgctgaggcgcgaaagcgtggggagcgaacaggattagataccctggtagtccacgccgtaaacgttgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccagggcttgacatcccgctgaccctcctagagataggagctctcttcggagcagcggtgacaggtggtgcatggttgtcgtcagctcgtgtcgtgagatgttgggttaagtcccgcaacgagcgcaacccttgtccttagttgccagcatttagttgggcactctagggagactgccgtcgacaagacggaggaaggtggggatgacgtcaaatcatcatgccccttatgtcctgggctacacacgtgctacaatggatggaacaacgggcagccaactcgcgagagtgcgcgaatcccttaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaaccgcaaggagccagccgccgaaggtggggcagatgattggggtgaagtcgtaacaaggtatccg

SEQ ID NO: 170 - DNA, 1415 bp, Aneurinibacillus terranovensis
gacgaacgctggcggcgtgcctaatacatgcaagtcgagcggacytttaaaagcttgcttttaaaggttagcggcggacgggtgagtaacacgtgggcaacctgcctgtaagctcgggataactccgggaaaccggagctaataccgaatacgattcgcaaccgcatggttgcgaatggaaagttttcgaacacttacagatgggcccgcggcgcattagctggttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggttttcggatcgtaaagctctgttgtcagggaagaaccgccgggacgacctcccggtctgacggtacctgacgagaaagccccggctaactacgtgccagcagccgcggtaatacgtagggggcaagcgttgtccggaattattgggcgtaaagcgcgcgcaggcggccttttaagtcaggtgtgaaagcccgcggctcaaccgtggagggccacctgaaactgggaggcttgagtgcaggagaggagagcggaattccacgtgtagcggtgaaatgcgtagagatgtggaggaacacccgtggcgaaggcggctctctggcctgtaactgacgctgaggcgcgaaagcgtggggagcaaacaggattagataccctggtagtccacgccgtaaacgatgagtgctaggtgttggggactccaatcctcagtgccgcagctaacgcaataagcactccgcctggggagtacggccgcaaggctgaaactcaaaggaattgacggggacccgcacaagcggtggagcatgtggtttaattcgaagcaacgcgaagaaccttaccaggacttgacatcccgctgacccctctagagatagaggctcccttcggggcagcggtgacaggtggtgcatggttgtcgtcagctcgtgtcgtgagatgttgggttaagtcccgcaacgagcgcaacccttgtccgtagttgccagcattgagttgggcactctacggagactgccgtcgacaagacggaggaaggtggggatgacgtcaaatcatcatgccccttatgtcctgggctacacacgtgctacaatggatggtacaacgggccgccagctcgcgagagtgagcgaatccctaaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtgaggtaacc

SEQ ID NO: 171 - DNA, 1219 bp, Aneurinibacillus thermoaerophilus
ttcctgaggttagcggcggacgggtgagtaacacgtaggcaacctgcctgtacgaccgggataactccgggaaaccggagctaataccggataggatgccgaaccgcatggttcggcatggaaaggcctttgagccgcgtacagatgggcctgcggcgcattagctagttggtggggtaacggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaggaaggtcttcggatcgtaaaactctgttgtcagggaagaaccgccgggatgacctcccggtctgacggtacctgacgagaaagccccggctaactacgtgccagcagccgcggtaatacgtagggggcaagcgttgtccggaattattgggcgtaaagcgcgcgcaggcggcttcttaagtcaggtgtgaaagcccacggctcaaccgtggagggccatctgaaactggggagcttgagtgcagaaggagagcggaattccacgtgtacggtgaaatgcgtaagatgtggaggaacaccagtggcgaaggcggctctctggcctgtaactgacgtgaggcgcgaaagcgtggggagcaaacaggattaataccctggtagtcacccgtaaacgatgagtgctaggtgttggggagtccacctcctcagtgcgcataacgcaataacactcccctgggagtacgccgcaaggctgaaactcaaaggaattgacggggacccgcacaagcggtggagcatgtggtttaatttaagcaacgcgaaaaccttaccagggcttgacatcccgctgacccctccagagatggaggtttccttcgggacagcggtgacaggtggtgcatggttgtcgtcagctcgtgtcgtgagatgttgggttaagtcccgcaacgagcgcaacccttgtcctttgttgccagcattcagttgggcactctaaggagactgccgtcgacaagacggaggaaggtggggatgacgtcaaatcatcatgccccttatgtcctgggctacacacgtgctacaatggacggtacaacgggcgtgccaacccgcgagggtgagccaatccctaaaaaccgttctcagttcggattgcaggctgcaactcgc

SEQ ID NO: 172 - DNA, 1541 bp, Anoxybacillus contaminans
ttagaggttgatcctggctcaggacgaacgctggcggcgtgcctaatacatgcaagtcgagcggaccgaaaagaagcttgcttcgattcggttagcggcggacgggtgagtaacacgtgggcaacctgccctgtagacggggataacaccgagaaatcggtgctaataccggataacacgaaakgycgcatggyctttcgttgaaaggcggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggattgtaaagctctgttgttagggaagaacaagtaccgcagtaactggcggtaccttgacggtacctaacgagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttacaccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaggtcttgacatcccttgacaacccaagagattgggcgttccccttcgggggacaaggtgacaggtggtgcatggttgtcgtcagctcgtgtcgtgagatgttgggttaagtcccgcaacgagcgcaacccttgaccttagttgccagcattgagttgggcactctaaggtgactgccgatgacaaatcggaggaaggtggggatgacgtcaaatcatcatgccccttatgacctgggctacacacgtgctacaatgggcggtacaaagggttgcaaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagccagccgccgaaggtggggcagatgattggggtgaagtcgtaacaaggtagccgtatcggaaggtgcggctggatca

SEQ ID NO: 173 - DNA, 1405 bp, Anoxybacillus flavithermus
  modified_base (12)..(12): a, c, t, g, unknown or other
gcggacgaatcnaaagcttgcttttgattcgttagcggcggacgggtgagtaacacgtgggcaacctgccctgtagacggggataacaccgagaaatcggtgctaataccggataacacgaaatgtcgcatgacgtttcgttgaaagacggcgcaagctgtcgctacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaacgcagtaactggcgttaccgtgacggtacctaacgagaaagccacggctaactacgtgccagcagccgcggtaatacgtaggtggcaagcgttgtccggaattattgggcgtaaagcgcgcgcaggcggttccttaagtctgatgtgaaagccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgtaagtgttagagggtatccgccctttagtgctgtagctaacgcattaagcactccgcctggggagtacgctcgcaagagtgaaactcaaaggaattgacgggggcccgcacaagcggtggagcatgtggtttaattcgaagcaacgcgaagaaccttaccaagtcttgacatcccctgacaacccgagagatcgggcgttcccccttcggggggacagggtgacaggtggtgcatggttgtcgtcagctcgtgtcgtgagatgttgggttaagtcccgcaacgagcgcaaccctcgaccttagttgccagcattcagttgggcactctaaggtgactgccggctaaaagtcggaggaaggtggggatgacgtcaaatcatcatgccccttatgacctgggctacacacgtgctacaatgggcggtacaaagggtcgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgaggtaacccttacgggagc

SEQ ID NO: 174 - DNA, 1483 bp, Arcanobacterium haemolyticum
  modified_base (679)..(679): a, c, t, g, unknown or other
cgaacgctggcggcgtgcttaacacatgcaagtcgaacgatgaaggctcctgcttgcgggggttggattagtggcgaacgggtgagtaatacgtgagtaacctgcccctttctcttgggataagccttggaaacgaggtctaatactagatattctgcttctgccgcatggtgggggttggaaaggttttttctggtgggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacggaagtctgatgcagcgaacgccgcgtgggggatgaaggctttcgggttgtaaactccttttaacactgaacaaggcgaaagttgagggtaggtgttgaataagcgccggctaactacgtgccagcagccgcggtaatacgtagggcgcgagcgttgtccggaattattgggcgtaaagagctcgtaggcggtttgtcgcgtctgctgtgaaagaccggggcttaactccggggctgcagtgggtacgggcaggctagagtgcggtaggggtaattggaattcctggtgtagcggtggaatgcgcagatatcaggaggaacaccnatggcgaaggcaggttactgggccgttactgacgctgaggagcgaaagcatggggagcgaacaggattagataccctggtagtccatgccgtaaacgttgggcactaggtgtggggccttttccatgggttctgtaccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccgggattatgcagagatgtgtgagtcttcggactggtgtacaggtggtgcatggttgtcgtcagctcgtgtcgtgagatgttgggttaagtcccgcaacgagcgcaacccttgtcttgtgttgccagcacgttatggtggggactcacgagagactgccggggttaactcggaggaaggtggggatgacgtcaaatcatcatgccccttatgtcttgggcttcacgcatgctacaatggctggtacagagggttgcgagcttgtgagggtgagcgaatcccttaaagccagtctcagttcggattggggtctgcaactcgaccccatgaagtcggagtcgctagtaatcgcagatcagccaacgctgcggtgaatacgttcccgggccttgtacacaccgcccgtcacgtcacgaaagttggtaacacccgaagcccgtggcctaactcgtttgagggggagcggacgaaggtgggattagccattgggacgaagtcgtaacaaggtagccgtaccggaagg

SEQ ID NO: 175 - DNA, 1293 bp, Arcanobacterium pyogenes
  modified_base (921)..(921): a, c, t, g, unknown or other
catgcagtcgaacgatgaagccggggctttttgttttggtggattagtggcgaacgggtgagtaatacgtgagtaacctgcccttgtctttgggataagcctgggaaactgggtctaataccggatattctgcttttgccgcatggtgggggttggaaagattttttggatggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactcctttcagtacagaagaagcatttttgtgacggtatgtgcagaagaagcgccggctaactacgtgccagcagccgcggtaatacgtagggcgcgagcgttgtccggaattattgggcgtaaagagctcgtaggcggtttgttgcgcctgctgtgaaagaccggggcttaacttcggggttgcagtgggtacgggcagactagagtgtggtaggggtaattggaattcctggtgtagcggtggaatgcgcagatatcaggaggaacaccgatggcgaaggcaggttactgggccattactgacgctgaggagcgaaagcgtgggtagcgaacaggattagataccctggtagtccacgctgtaaacgttgggcactaggtgtggggccttttccacgggttctgcgccgtagctaacgctttaagtgccccgcctggggagtacggccgcaaggttaaaactcaaggaattgacgggggcccgcacaagcggcggagcatgcggattaattcgatgcaacgcgaagaaccttaccaaggnttgacatacactgcgatgtgccagagatgtgcagccttcgggtggtgtacaggtggtgcatggttgtcgtcagctcgtgtcgtgagatgttgggttaagtcccgcaacgagcgcaacccttgtcctgtgttgccagcatgttgtggtggggactcacgggagactgccggggttaactcggaggaaggtggggatgacgtcaaatcatcatgccccttatgtcttgggcttcacgcatgctacaatggccggtacagagggttgcgagcctgtgagggtgagctaatcccttaaagctggtctcagttcggattggggtctgcaactcgaccccatgaagtcggagtcgctagtaatcgcagatcagcaacg

SEQ ID NO: 176 - DNA, 1519 bp, Arcobacter butzleri
tttatggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatattcctttttatcaaaagataaaaagggaaagatttattggtaagagattagcctgtattgtatcagttagttggtggggtaatggcctaccaagacgatgacgcataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatataagaagataatgacggtattatatgaataagcaccggctaactccgtgccagcagccgcggtaatacggagggtgcaagcgttactcggaatcactgggcgtaaagagcgtgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacaatattgacgctgagacgcgaaagcgtggggagcaaacaggattagataccctggtagtccacgccctaaacgatgtacactagttgttgtgaggctcgaccttgcagtaatgcagttaacacattaagtgtaccgcctggggagtacggtcgcaagattaaaactcaaaggaatagacggggacccgcacaagcggtggagcatgtggtttaattcgacgatacacgaagaaccttacctggacttgacatagtaagaatgatttagagatagattagtgtctgcttgcagaaacttgcatacaggtgctgcacggctgtcgtcagctcgtgtcgtgagatgttgggttaagtcccgcaacgagcgcaaccctcgtccttagttgctaacagttcggctgagaactctaaggagactgcctacgcaagtaggaggaaggtgaggatgacgtcaagtcatcatggcccttacgtccagggctacacacgtgctacaatggggtatacaaagagcagcaatacggtgacgtggagcaaatctcaaaaatgcctcccagttcggattgtagtctgcaactcgactacatgaagttggaatcgctagtaatcgtagatcagctatgctacggtgaatacgttcccgggtcttgtactcaccgcccgtcacaccatgggagttgaactcattcgaagcggggatgctaaagtagctaccttccacagtggattcagcgactggggtgaagtcgtaacaaggtaaccgtaggagaacctgcggttggatcacctcctttca

SEQ ID NO: 177 - DNA, 1462 bp, Arcobacter cryaerophilus
  modified_base (195)..(195): a, c, t, g, unknown or other
  modified_base (936)..(936): a, c, t, g, unknown or other
  modified_base (1098)..(1098): a, c, t, g, unknown or other
atggagagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatactccttgttaactnaagttaataagggaaagatttattggtaagagattagcctgtattgtatcagttagttggtggggtaatggcctaccaagacaatgacacataactggtttgagaggatgatcagtcacactggaactgagacacggtccagactcctacgggaggcagcagtggggaatattgcacaatggacgaaagtctgatgcagcaacgccgcgtggaggatgacacatttcggtgcgtaaactccttttatatgagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacattattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaatncgaagatacacgaagaaccttacctggacttgacatagtaagaactttctagagatagattggtgtctgcttgcagaaacttatatacaggtgctgcacggctgtcgtcagctcgtgtcgtgagatgttgggttaagtcccgcaacgagcgcaaccctcgtntttagttgctaacagttcggctgagaactctaaacagactgcctacgcaagtaggaggaaggtgaggacgacgtcaagtcatcatggcccttacgtccagggctacacacgtgctacaatgggatatacaaagagccgcaatacggtgacgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaaatagctaccttccacagtggatttggcgactgggg

SEQ ID NO: 178 - DNA, 1482 bp, Arthrobacter agilis
gatcctggctcaggatgaacgctggcggcgtgcttaacacatgcaagtcgaacgatgaacctcacttgtggggggattagtggcgaacgggtgagtaacacgtgagtaacctgcccttgactctgggataagcctgggaaaccgggtctaatactggatacgaccttctggcgcatgccatgttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgaaggccttcgggttgtaaacctctttcagtagggaagaagcctgtcttttgggtgggtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaatgatgcagagatgtgtcagccacttgtggccggtttacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagttggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggaccggcgattgggactaagtcgtaacaag

SEQ ID NO: 179 - DNA, 1519 bp, Arthrobacter arilaitensis
ggagagtttgatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatattacctcttgccgcatggcaggtggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgcttcagagatggagtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcct

SEQ ID NO: 180 - DNA, 1468 bp, Arthrobacter bergerei
ctggctcaggacgaacgctggcggcgtgcttaacacatgcaagtcgaacgatgaccccgtgcttgcacgggtgattagtggcgaacgggtgagtaacacgtgagtaacctgcccctgactctgggataagcccgggaaactgggtctaatactggatatgacctttaaccgcatggtttttggtggaaagatttatcggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatctactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttccagaccgcctcagagatggggtttcccttcggggctggttcacaggtggtgcatggttgtcgtcagctcgtgtcgtgagatgttgggttaagtcccgcaacgagcgcaaccctcgttccatgttgccagcacgtaaaggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggagggagtcgtcgaaggtgggactggcgattgggactaagtcgtaaca

SEQ ID NO: 181 - DNA, 1464 bp, Arthrobacter globiformis
cctggctcaggatgaacgctggcggcgtgcttaacacatgcaagtcgaacgatgatccggtgcttgcaccggggattagtggcgaacgggtgagtaacacgtgagtaacctgcccttgactctgggataagcctgggaaactgggtctaataccggatatgactcctcatcgcatggtggggggtggaaagcttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttctccttttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggactggcgattgggactaagtcg

SEQ ID NO: 182 - DNA, 1472 bp, Arthrobacter nicotianae
  modified_base (608)..(608): a, c, t, g, unknown or other
gatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatatgacctcgcaccgcatggtgcggggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacggncagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgctccagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccacttgtgtgggggagtcgtcgaaggtgggactggcgattgggactaagtcgtaacaag

SEQ ID NO: 183 - DNA, 1345 bp, Atopobium minutum
tcaggatgaacgctggcggcgcgcctaacacatgcaagtcgaacgattaaagcatcttttagatgtgtataaagtggcgaacggctgagtaacacgtgggcaacctgcccttttctttgggatagctacgggaaaccgtgggtaataccgaatatttcttgagtgtcgcatggcacacaagacaaagcgtctagcggaaaaggatgggcccgcggcctgttagcttgttggtggggtaatggcctaccaaggcagttatgggtagccgggttgagagaccgaccggccagattgggactgagacacggcccagactcctacgggaggcagcagtggggaatcttgcgcaatgggggaaaccctgacgcagcgacgccgcgtgcgggatgaaggccttcgggttgtaaaccgctttcagcagggacgaggccgcaaggtgacggtacctgcagaagaagctccggctaaatacgtgccagcagccgcggtaatacgtatggagcaagcgttatccggattcattgggcgtaaagcgctcgtaggcggtctgttaggtcggtaagttaaatccgggggctcaacccccgtccgcttccgataccggcagacttgagtttggtaggggaaggtggaattcctagtgtagcggtggaatgcgcagatattaggaagaacaccggtggcgaaggcggccttctgggccataactgacgctgaggagcgaaagctaggggagcgaacaggattagataccctggtagtcctagccgtaaacgatggacactaggtgtggggggatgtaccttccgtgccgcagctaacgcattaagtgtcccgcctggggagtacgaccgcaaggttaaaactcaaaggaattgacgggrgcccgcacaagcagcggagcatgtggcttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttgggttaagtcccgcaacgagcgcaacccttgtcgcatgttgccagcaggtcaagctgggcacccgtgcgagaccgccggcgtcaagccggaggaaggtggggacgacgtcaagtcatcatgccccttatgtcctgggctgcacacgtgctacaatggtcggcacagcgggaagcaaacttgcgaaagtaagccaatcccttaaagccggccccagttcggattggaggctgcaacccgcctccatgaagtcggagttgctagtaatcgcggatcagcacgccgcggtgaatgcgttcccgggccttg

SEQ ID NO: 184 - DNA, 1517 bp, Atopobium parvulum
atggagagttcgatcctggctcaggatgaacgctggcggcgcgcctaacacatgcaagtcgaacgattaaagcaccttcgggtgtgtataaagtggcgaacggctgagtaacacgtgggcaacctgcccctttcattgggatagccacgggaaaccgtggataataccgaatacttcgagacttccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgctcgctctcgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagccgtaaacgatggacactaggtgtgggggagtatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttaggagggagacgccgaaggtgtggttggtaaggggggtgaagtcgtaacaaggtagccgtaccggaaggtgcggctggatcacctcctttctagggag

SEQ ID NO: 185 - DNA, 1518 bp, Atopobium rimae
atggagagttcgatcctggctcaggatgaacgctggcggcgcgcctaacacatgcaagtcgaacggttaaagcaccttttaggtgtgtataaagtggcgaacggctgagtaacacgtgggcaacctgccctcctcttggggatagcctcgggaaaccgaggataatacccgatacttcaatgtggccgcatgacgacattgagaaagcttttgcggagaaggatgggcccgcggcctgttagcttgttggtggggtagaggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggacgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccggaggctcaacctccgcccgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagctgtaaacgatggacactaggtgtgggagaatacgtcttccgtgccgcagctaacgcattaagtgtcccgcctggggagtacggccgcaaggctaaaactcaaaggaattgacggggacccgcacaagcagcggagcatgtggtttaattcgaagcaacgcgaagaaccttaccagggcttgacatgtaggtgaagcggcggaaacgtcgtggccgaaaggagcctacacaggtggtgcatggctgtcgtcagctcgtgtcgtgagatgttaggttaagtcctgcaacgagcgcaaccctcgtcgtatattgccagcggttcggccgggcacctatacgagaccgccggcgtcaagccggaggaaggtggggacgacgtcaagtcatcatgccccttatgtcctgggctacacacgtgctacaatggccggcacaatgagctgccaacccgcaagggcgagcgaatctctaaagccggtcccagttcggattggaggctgcaacccgcctccatgaagtcggagttgctagtaatcgcggatcagcacgccgcggtgaatgcgttcccgggtcttgtacacaccgcccgtcacaccacccgagtcgattgcacccgaagtcgtcggcctaaccttttaggagggagacgccgaaggtgtggttggtaaggggggtgaagtcgtaacaaggtagccgtaccggaaggtgcggctggatcacctcctttctagggag

SEQ ID NO: 186 - DNA, 1355 bp, Atopobium sp. BS2
aaagcaccttcgggtgtgtataaagtggcgaacggctgagtaacacgtgggcaacctgcccctctcattgggatagccacgggaaaccgtggataataccgaatacttcgagacttccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccataactgacgctgaggagcgaaagctaggggagcaaacaggattagataccctggtagtcctagccgtaaacgatggacactaggtgtgggggaatatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttagga

SEQ ID NO: 187 - DNA, 1487 bp, Atopobium sp. F0209
gagtttgatcctggctcaggatgaacgctggcggcacgcttaacacatgcaagtcgaacgattaaagcaccttcgggtgtgtatagagtggcgaacggctgagtaacacgtgggcaacctgcccttcagtttggaatagctacgggaaaccgtgggtaataccggatgatccacttccctcgcatgaaggaagtggcaaagatttatcgctgaaggatgggcccgcggcctgttagcttgttggtgaggtaacggctcaccaaggcagtaatgggtagccgggttgagagaccgaccggccagattgggactgagacacggcccagactcctacgggaggcagcagtggggaatcttgcgcaatgggcgaaagcctgacgcagcgatgccgcgtgcgggatgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcaggagttaaatccgggggctcaacccccgtccgctcctgataccggcaggcttgagtctggtaggggaaggcggaattccaagtgtagcggtggaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggggatcatccctccgtgccgcagctaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatataggtgaagcggtggaaacaccgtagccgaaaggagcctatacaggtggtgcatggctgtcgtcagctcgtgtcgtgagatgttgggttaagtcccgcaacgagcgcaacccccgtcgtatgttgccagcggttcggccgggcacccatacgagaccgccggcgtcaagccggaggaaggtggggacgacgtcaagtcatcatgccccttatgtcctgggctgcacacgtgctacaatggccggcacaatgggctgccaggtcgcgagaccgagcgaatccctaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaaccttttggagggaggtgccgaaggtgtggagggtaaggggggtgaagtcgtaacaaggtagccgtaccggaaggtgc

SEQ ID NO: 188 - DNA, 1473 bp, Atopobium sp. ICM42b10
agagtttgatcctggctcaggatgaacgctggcggcgcgcctaacacatgcaagtcgaacgattaaagcaccttcgggtgtgtataaagtggcgaacggctgagtaacacgtgggcaacctgcccctctcattgggatagccacgggaaaccgtggataataccgaatacttcgagtctcccgcatggaagactcgagaaagctccggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggcgaaagtgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggagtgcgcagatattaggaagaacaccagtggcgaaggcggccttctgggccataactgacgctgaggagcgaaagctaggggagcaaacaggattagataccctggtagtcctagccgtaaacgatggacactaggtgtgggggaatatttcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacatttaggtgaagcggcggaaacgtcgtggccgaaaggagcctaaacaggtggtgcatggctgtcgtcagctcgtgtcgtgagatgttaggttaagtcctgcaacgagcgcaaccctcgtcgtatgttgccagcggttaggccgggcacccatacgagaccgccggcgtcaagccggaggaaggtggggacgacgtcaagtcatcatgccccttatgtcctgggctacacacgtgctacaatggccggcacaatgggctgccaacccgcgagggtgagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgattgcacccgaagtcgtcggcctaaccttttaggagggagacgccgaaggtgtggttggtaaggggggtgaagtcgtaacaaggtaacc

SEQ ID NO: 189 - DNA, 1267 bp, Atopobium sp. ICM57
cgctggcggcgcgcctaacacatgcaagtcgaacgagtggcgaacggctgagtaacacgtgggcaacctgcccctctcattgggatagccacgggaaaccgtggataataccgaatactgaaaggcggagagggatgggcccgcggcctgttagcttgttggtggggtaacggcctaccaaggcaatgatgggtagctgggttgagagaccgaccagccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgatgacggtacctgcagaagaagccccggctaactacgtgccagcagccgcggtaatacgtagggggcaagcgttatccggattcattgggcgtaaagcgctcgtaggcggtctgttaggtcgggagttaaatccgggggctcaacccccgttcgctcccgataccggcagacttgagtttggtaggggaaggtggaattcctagtgtagcggtggaatgcgcagatattaggaagaacaccagtggcgaaggcggccttctgggccaactgacgctgaggagcgaaagctaggggagcaaacaggattagataccctggtagtcctagccgtaaacgatggacactaggtgtgggggcttccgtgccgcagctaacgcattaagtgtcccgcctggggagtacggccgcaaggctaaaactcaaaggaattgacgggggcccgcacaagcagcggagcatgtggtttaattcgaagcaacgcgaagaaccttaccagggcttgacattaacaggtggtgcatggctgtcgtcagctcgtgtcgtgagatgttaggttaagtcctgcaacgagcgcaaccctcgtcgtatgttgccagcggccgggcacccatacgagaccgccggcgtcaagccggaggaaggtggggacgacgtcaagtcatcatgccccttatgtcctgggctacacacgtgctacaatggccggcaatgggctgccaacccgcgagggtgagcgaatccctccggtcccagttcggatggaggctgcaacccgcctccagaagtcggagttgctagtaatcgcggatcagcacgccgcggtgaatgcgttcccgggccttgtacacaccgcccgtcacaccacccgagtcgattgcacccgaagtcgtcgcctagggagacgccgaa

SEQ ID NO: 190 - DNA, 1521 bp, Atopobium vaginae
tttgaacggagagttcgatcctggctcaggatgaacgctggcggcgcgcctaacacatgcaagtcgaacgattaaagcaccttcgggtgtgtataaagtggcgaacggctgagtaacacgtgggcaacctgccctttgcactgggatagcctcgggaaaccgaggttaataccggatactccatatatatcgcatgatgtatatgggaaagctccgacggcaaaggatgggcccgcggcctgttagctagttggtggggtaacggcctaccaaggcaatgatgggtagccgggttgagagaccgaccggccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgaggccgcaaggtgacggtacctgcagaagaagccccggctaactacgtgccagcagccgcggtaatacgtagggggcaagcgttatccggattcattgggcgtaaagcgcgcgtaggcggtttgttaggtcaggagttaaatctgggggctcaacccctatccgctcctgataccggcaggcttgagtctggtaggggaaggcggaattccaagtgtagcggtgaaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggagattatactttccgtgccgcagccaacgcattaagtgtcccgcctggggagtacggtcgcaagactaaaactcaaaggaattgacgggggcccgcacaagcagcggagcatgtggcttaattcgaagcaacgcgaagaaccttaccagggcttgacatttaggtgaagcagtggaaacactgtggccgaaaggagcctaaacaggtggtgcatggctgtcgtcagctcgtgtcgtgagatgttgggttaagtcccgcaacgagcgcaacccttgtcgcatgttgccagcggttaaagccgggcacccatgcgagaccgccggcgttaagccggaggaaggtggggacgacgtcaagtcatcatgccccttatgtcctgggctgcacacgtgctacaatggccggcacagagggctgcaactgcgcgagcagaagcgaatccctaaagccggtcccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgtcggcctaacctgcaaaggagggagacgccgaaggtgtggagggtaaggggggtgaagtcgtaacaaggtagccgtaccggaaggtgcggctggatcacctcctttct

SEQ ID NO: 191 - DNA, 1285 bp, Aurantimonas coralicida
gtaacgcgtgggaatctacccatccctacgggatagctccgggaaactggagataataccgtatacgtcctccgggagaaagatttatcggggatggatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacaggattagataccctggtagtccacgccgtaaacgatggaagctagccgtcggaggatttatccttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgcctcgacggtatccggagacggatgccttccttcgggacgagtgcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagccaactcgcgagagtgagctaatcccaaaaaaccgtctcagttcggattgcactctgcaactcgggtgcatgaagttggaatcgctagtaatcgtggatcagcatgccacggtgaatacgttcccgggccttgtacacaccgcccgtcacaccatggkagwkgkttmtmmcsgaasatrgtsc

SEQ ID NO: 192 - DNA, 1390 bp, Aureimonas altamirensis
ctcagaacgaacgctggcggcaggcttaacacatgcaagtcgaacgcacctttcggggtgagtggcagacgggtgagtaacgcgtgggaatctacccttctctacgggatagctccgggaaactggaattaataccgtatacgtcctgagggagaaagatttatcggggaaggatgagcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtggggacgataatgacggtacccacagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatcttgagttcggaagaggtaagtggaattgcgagtgtagaggtgaaattcgtagatattcgcaggaacaccagtggcgaaggcggcttactggtccgatactgacgctgaggtgcgaaagcgtggggagcaaacaggattagataccctggtagtccacgccgtaaacgatggaagctagccgtcgggtgatttatcactcggtggcgcagcaaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacgatgaccggagacggacatcttccttcgggacgtggacacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggcggtgacaatgggcagccaactcgcgagagtgcgctaatcccaaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaaccgcaaggaggcagccaaccacgg

SEQ ID NO: 193 - DNA, 1319 bp, Auritibacter ignavus
ctggcggcgtgcttaacacatgcaagtcgaacgagtggcgaacgggtgagtatcacgtgagtaacctgcccttgactctgggataagcctgggaaactgggtctaatactggatatggaaaggcggttttggatggactcgcggcctatcagcttgttggtggggtaatggcctaccaaggcttcgacgggtagccggcctgagagggtgaccggccacactgggactgagacacggcccagactcctacgggaggcagcagtgggggatattgcacaatgggcgcaagcctgatgcagcgacgtcgcgtgagggatgacggccttcgggttgtaaacctctttcagcagggaagatgacggtacctgcagaagaagcaccggctaactacgtgccagcagccgcggtaatacgtagggtgcgagcgttatccggaattattgggcgtaaagagctcgtaggcggtttgtcgcgtctgctgtgaaagctcagggcttaactctgagtttgcagtgggtacgggcagactggagtgcagtaggggagattggaattcctggtgtagcggtggaatgcgcagatatcaggaggaacaccgatggcgaaggcaggtctctgggctgactgacgctgaggagcgaaagcatggggagcgaacaggattagataccctggtagtccatgccgtaaacggtgggcgctaggtgtgagtcggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcacgtggggactcataggagactgccggggtcaactcggaggaaggtggggatgacgtcaaatcatcatgccccttatgtcttgggcttcacgcatgctacaatggccggcagagggttgcgatactgtgaggttgagctaatcccttctggtctcagttcggatggggtctgcaactcgaccccagaagtcggagtcgctagtaatcgcagatcagcaatgctgcggtgaatacgttcccgggccttgtacacaccgcccgtcgagtcacgaaagttggtaacacccgaagccggtgcctagggagccgtcgaaggtgggactggcgattgggactaagtcgtaacaaggtagccgtaccggaag

SEQ ID NO: 194 - DNA, 1429 bp, Averyella dalhousiensis
ccaggagctacatgcagtcgagcggtagcacaggggagcttgctcctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtcgagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccctgtataa

SEQ ID NO: 195 - DNA, 1403 bp, Bacillus aeolius
tggcggcgtgcctaatacatgcaagtcgagcgaacggatggagagcttgctctcctgacgttagcggcggacgggtgagtaacacgtgggcaacctgcctgtaagaccgggataacttcgggaaaccggagctaataccggataattcctttcctcgcatgaggaaaggttgaaaggcggcttcggctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggtcttcggatcgtaaagctctgttgttagggaagaacaagtaccgttcgaataggcggtaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggagacttgagtgcagaagaggagagcggaattccatgtgtagcggtgaaatgcgtagagatatggaggaacaccagtggcgaaggcggctctcttgtctgtaactgacgctgaggcgcgaaagcgttgggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctacctctagatagagggttccccttcgggggacggaatgacaggtggtgcatggttgtcgtcagctcgtgtcgtgagatgttgggttaagtcccgcaacgaacgcaacccttgaccttagttgccagcattcagttgggcactctaaggtgactgccggtgacaaaccggaagaaagtggggatgacgtcaaatcatcatgccccttatgacctgggctacacacgtgctacaatgggtggtacaaagggctgcgatgccgcgaggctgagccaatcccaaaaaaccactctcagttcggattgcaggctgcaactcgcctgcatgaagccggaatcgctagtaatcgcggatcagcatgccgcggtgaatacgttcccgggccttgtacacaccgcccgtcacaccacgagagtttgcaacaccc

SEQ ID NO: 196 - DNA, 1382 bp, Bacillus aerophilus
  modified_base (8)..(12): a, c, t, g, unknown or other
agcggacnnnnnggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgagagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgataaccctagagatagggctttcccttcggggaccggggagggtgatgggaaactgggaaacttgctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtg

SEQ ID NO: 197 - DNA, 1392 bp, Bacillus aestuarii
gcggaccaatagaagcttgcttctgttggttagcggcggacgggtgagtaacacgtgggcaacctgcctgtaagactgggataacttcgggaaaccggagctaataccggataattcatcccctcgcatgagggggtgctgaaagtcggttcacgctgacacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagttgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttacgacctccctagagatagggatttccccttcgggggacggaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgttacaatggatggtacaaagggcagcgaaaccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaac

SEQ ID NO: 198 - DNA, 1505 bp, Bacillus alcalophilus
  modified_base (97)..(97): a, c, t, g, unknown or other
  modified_base (203)..(203): a, c, t, g, unknown or other
  modified_base (441)..(441): a, c, t, g, unknown or other
gacgaacgctggcggcgtgcctaatacatgcaagtcgagcggaccaaagggagcttgctcccagaggttagcggcggacgggtgagtaacacgtggncaacctgccctgtagactgggataacatcgagaaatcggtgctaataccggataatcaaaggaatcacatggttcttttgtaaaagatggctccggctatcactangggatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgntcgaataggtcggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaatatcggggctcaaccccgaggggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcgaaaccgcgaggtcgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtg

SEQ ID NO: 199 - DNA, 1410 bp, Bacillus amyloliquefaciens
  modified_base (965)..(965): a, c, t, g, unknown or other
  modified_base (1393)..(1393): a, c, t, g, unknown or other
  modified_base (1397)..(1398): a, c, t, g, unknown or other
tcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaacttaccgcggttatacgtcggtggcaagcgttagacagnaatcgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtancctnnaggagccagccg

SEQ ID NO: 200 - DNA, 1391 bp, Bacillus anthracis
  modified_base (9)..(11): a, c, t, g, unknown or other
  modified_base (1380)..(1380): a, c, t, g, unknown or other
cttgctctnnngaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgtatccggaattattgggcgtaaagcgcgcgcaggtggtttcttaagtctgatgtgaaagccccggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttanggagccagccg

SEQ ID NO: 201 - DNA, 1411 bp, Bacillus atrophaeus
tcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccg

SEQ ID NO: 202 - DNA, 1442 bp, Bacillus badius
acgaacgctggcggcgtgcctaatacatgcaagtcgagcggacttgacggaagcttgcttccgttcaagttagcggcggacgggtgagtaacacgtgggtaacctgcctgtaagactgggataactccgggaaaccggggctaataccggatattctttttcttcgcatgaagaagaatggaaaggcggcttttaactgtcacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtacggaagtaactgtccgtaccttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggccgcacaagcggtggagcatgtggtttaattcgaagcaacgcgaagaaccttaccaggtcttgacatcccgctgaccggtctggagacaggcctttcttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcaaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaacacgagagtttgcaacacccgaagtcggtggggtaaccttacgggagcca

SEQ ID NO: 203 - DNA, 1389 bp, Bacillus cereus
tcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtg

SEQ ID NO: 204 - DNA, 1371 bp, Bacillus circulans
aagcttgcttttaaagttagcggcggacgggtgagtaacacgtgggcaacctgcctgtaagactgggataacttcgggaaaccggagctaataccggataatccttttcctctcatgaggaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaaaaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtg

SEQ ID NO: 205 - DNA, 1351 bp, Bacillus clausii
  modified_base (230)..(230): a, c, t, g, unknown or other
  modified_base (1341)..(1342): a, c, t, g, unknown or other
ggacgggtgagtaacacgtgggcaacctgccctttagactgggataactccgggaaaccggagctaataccggataatccctttctccacctggagagagggtgaaagatggcttcggctatcactaggggatgggcccgcggcgcattatctagttggtaaggtaacggcttaccaaggcaacgatgcgtacccgacctgagagggtgatcggccacactgggactganacacggcccagactcctacgggaggcagcagtagggaatcttccgcaatggacgaaagtctgacggagcaacgccgcgtgagtgaggaaggccttcgggtcgtaaagctctgttgtgagggaagaagcggtaccgttcgaatagggcggtaccttgacggtacctcaccagaaaccacggctaactacgtgccagcagccgcggtaatacgtaggtggcaagcgttgtccggaattattgggcgtaaagcgcgcgcagcggcttcttaagtctgatgtgaaatctcggggctcaaccccgagcggccattgaaactggggagcttgagtgcaaagagagagtggaattccacgtgtagcggtgaaatgcgtagagatgtggaggaacaccagtggcaggactctctggtctgtaactgacctgagcgcgaaagcgtggagcaaacagattaataccctggtagtccacgccgtaaacgatgagtgctagtgttaggggtttccatgcccgtagtgccaaagttaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccacccaagagattgggcttccccttcgggggcaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggcaaccttnnggagccagc

SEQ ID NO: 206 - DNA, 1411 bp, Bacillus coagulans
  modified_base (10)..(10): a, c, t, g, unknown or other
tcgtgcggancttttaaagcttgcttttaaaaggttagcggcggacgggtgagtaacacgtgggcaacctgcctgtaagatcgggataacgccgggaaaccggggctaataccggatagttttttcctccgcatggaggaaaaaggaaagacggcttctgctgtcacttacagatgggcccgcggcgcattagctagttggtggggtaacggctcaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgccggggaagaacaagtgccgttcgaacagggcggcgccttgacggtacccggccagaaagccacggctaactacgtgccagcagccgcggtaatacgtaggtggcaagcgttgtccggaattattgggcgtaaagcgcgcgcaggcggcttcttaagttgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtcacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacctccctggagacagggccttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccagaaaaccattcccagttcggattgcaggctgcaacccgcctgcatgaagccggaatcgctagtaatcgcggatcagcatgccgcggtgaatacgttcccgggccttgtacacaccgcccgtcacaccacgagagtttgtaacacccgaagtcggtgaggtaaccttacggagccagccg

SEQ ID NO: 207 - DNA, 1483 bp, Bacillus firmus
gacgaacgctggcggcgtgcctaatacatgcaagtcgagcggacggatgggagcttgctcacacgtcagcggcggacgggtgagtaacacgtgggcaacctgcctgtaagactgggataactccgggaaaccggggctaataccggataatgcttttcctcgcatgaggaaaagctgaaagatggcatctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtaccggagtaactgccggtaccttgacggtacctgaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaa

SEQ ID NO: 208 - DNA, 1529 bp, Bacillus flexus
gatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggat

SEQ ID NO: 209 - DNA, 1462 bp, Bacillus fordii
gtgcctaatacatcgcaagtcgagcggatgaaagagagcttgctctctggattcagcggcggacgggtgagtaacacgtgggcaacctgcctgtaagactgggataactccgggaaaccggggctaataccggataacttcttttcccgcatggggagaggttgaaagacggttatgctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgacgaaggccttcgggtcgtaaaactctgttatcagggaagaacaagcatcgtttaactgacggtgccatgacggtacctgaccagaaagccacggctaactacgtgccagcagccgcggtaatacgtaggtggcaagcgttgtccggaattattgggccgtaaagcgcgcgcaggcggcttcttaagtctgatgtgaaagcccacggctcaaccgtggagggtcattggaaactgggaggcagttgtgcagaagaggagagcggaattccacgtgtagcggtgaaatgcgtaaagatgtggaggaacaccagtggcgaaggcggctctctggtctgtaactgacgctgaggcgcgaaagcgtgggtagcgaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacagatctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacagagggcagcgagaccgcgaggtggagcgaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggacagatgattggggtgaagtcg

SEQ ID NO: 210 - DNA, 1485 bp, Bacillus gelatini
gacgaacgctggcggcgtgcctaatacatgcaagtcgagcggacggaaggagagcttgctctctggaagttagcggcggacgggtgagtaacacgtgggcaacctgcctcatagatggggataacaccgagaaatcggtgctaataccgaataatagagcggagcgcatgctccgcgcttgaaagtcggctttgagctgacactatgagatgggcccgcggcgcattagctagtaggtgaggtaacggctcacctaggcgacgatgcgtagccgacctgagagggtgatcggccacactgggactgagacacggcccagactcctacgggaggcagcagtagggaatcttcggcaatggacgaaagtctgaccgagcaacgccgcgtgagtgatgaaggttttcggatcgtaaaactctgttgtcagggaagaacaagtacgagagtaactgctcgtaccttgacggtacctgaccagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccacttgagagatcaagctttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgaaaccgcaaggtggagccaatcccaaaaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaa

SEQ ID NO: 211 - DNA, 1504 bp, Bacillus halmapalus
  modified_base (46)..(46): a, c, t, g, unknown or other
  modified_base (661)..(661): a, c, t, g, unknown or other
gacgaacgctggcggcgtgcctaatacatgcaagtcgagcggactnacacaagcttgcttttgtaagttagcggcggacgggtgagtaacacgtgggcaacctgcccttaagactgggataacttcgggaaaccggagctaataccggataatataaagaacctcctggttctttattgaaagatggtttcggctatcgcttatggatgggcccgcggcgcattagctagttggtgaggtaacggctcaccaagccaacgatgcgtagccgacctgagagggtgatcggccacactgggactgagacacggcccagactcctacgggaggcagcagtagggaatcttccacaatggacgaaagtctgatggagcaacgccgcgtgagtgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccangtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtg

SEQ ID NO: 212 - DNA, 1457 bp, Bacillus halodurans
acgctggcggcgtgcctaatacatgcaagtcgagcggaccaaagggagcttgctcctggaggttagcggcgaacgggtgagtaacacgtgggcaacctgcctgtaagactgggataacatcgagaaatcggtgctaataccggataataaaaagaactgcatggttcttttttgaaagatggtttcggctatcacttacagatgggcccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcgaaagggcggcaccttgacggtacctaacgagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtacagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgacgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgcgaagccgcgaggtgaagccaatcccagaaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagat

SEQ ID NO: 213 - DNA, 1464 bp, Bacillus herbersteinensis
acgaacgctggcggcgtgcctaatacatgcaagtcgagcggacatttgagagcttgctctcaaatgttagcggcggacgggtgagtaacacgtgggtaacctgcctgtaagattgggataactccgggaaaccggagctaataccggataacattttgaaccgcatggttcgaaattgaaagatggctttcgrctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggcggttttttaagtctgatgtgaaagcccacggctcaaccgtggagggtcattggaaactggagaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcgaraccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtggacagatgat

SEQ ID NO: 214 - DNA, 1512 bp, Bacillus horti
  modified_base (761)..(763): a, c, t, g, unknown or other
gacgaacgctggcggcgtgcctaatacatgcaagtcgagcgagtgaaactgacggaagccttcgggtggaagacagtggatctagcggcggacgggtgagtaacacgtaggcaacctgcctgtaagatggggataactccgggaaaccggagctaataccgaataatcgttttgctcgcatgagcaaaaggtgaaaggtggcgcaastaccgcttacagatgggcctgcggcgcattagctagttggtgaggtaacggctcaccaaggcgacgatgcgtagccgacctgagagggtgatcggccacactgggactgagacacggcccagactctacgggaggcagcagtagggaatcttcggcaatggacgaaagtctgaccgagcaacgccgcgtgagtgaagaaggttttcggattgtaaaactctgttgttagggaagaacaagtatcggttgaataagccggtaccctgacggtacctaacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggagacttgagtgtaggagaggaaagcggaattccacgtgtagcggtgaaatgcgtagagatgtggaggaacaccagtggcgaaggcggctttctggcctataactgacgctgaggcgcgaaannntggggagcaaacaggattagataccctggtagtccacgccgtaaacgatgagtgctaggtgttaggggtttcgatacccttagtgccgacgctaacgcaataagcactccgcctggggagtacggccgcaaggctgaaactcaaaggaattgacggggacccgcacaagcagtggagcatgtggtttaattcgaagcaacgcgaagaaccttaccaggacttgacatccctctgaatcctctagagatagaggcgaccttcgggacagaggtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgtcctgggctacacacgtgctacaatgggcagtacaaagggtagcgaagcgcgaggtggagccaatcccataaagctgctctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggatagatgattggggtgaagtcgtaacaaggtagccgtatcggaagg

SEQ ID NO: 215 - DNA, 1437 bp, Bacillus idriensis
cctaatacatgcaagtcgagcggacttgctggagcttgctccagcaggttagcggcggacgggtgagtaacacgtgggcaacctgcctgtaagactgggataactccgggaaaccggagctaataccggatagtatcttgaaccgcatggttcaagttggaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccagccgcctaagt

SEQ ID NO: 216 - DNA, 1535 bp, Bacillus lentus
agagtttgatcctggctcaggacgaacgctggcggcgtgcctaatacatgcaagtcgagcgaatggatgggagcttgctcccagaagttagcggcggacgggtgagtaacacgtgggcaacctacctgtaagactgggataacttcgggaaaccggagctaataccggataacttctttcttctcctggagaaaggttgaaagacggcttcggctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttatcagggaagaacaagtatcggagtaactgccggtaccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggaaggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccaccctagagatagggacttccccttcgggggacagagtgacaggtggtgcatggttgtcgtcagctcgtgtcgtgagatgttgggttaagtcccgcaacgagcgcaacccttaaccttagttgccagcattcagttgggcactctaaggtgactgccggtgacaaaccggaggaaggtggggatgacgtcaaatcatcatgccccttatgacctgggctacacacgtgctacaatggatggtacaaagggttgcaagaccgcgaggtttagctaatcccataaaaccattctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtggggtaacccttacgggagccagccgccgaaggtgggacagatgattggggtgaagtcgtaacaaggtagcgtatcggaaggtgcggtggatca

SEQ ID NO: 217 - DNA, 1548 bp, Bacillus licheniformis
ggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 218 - DNA, 1404 bp, Bacillus megaterium
tcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaagg

SEQ ID NO: 219 - DNA, 878 bp, Bacillus nealsonii
  modified_base (121)..(121): a, c, t, g, unknown or other
gcggactttaaaagcttgcttttaaagttagcggcggacgggtgagtaacacgtgggcaacctgcctgtaagactgggataacttcgggaaaccggagctaataccggataattctttccnccacatggtggaaagctgaaagacggcatctcgctgtcacttacagatgggcccgcggcgcattagctagttggtgaggtaacggctcaccaaggcaacgatgcgtagccgacctgagagggtgatcggccacactgggactgaaacacggcccaaactcctacgggaggcagcagtagggaatcttccgcaatggacgaaagtctgacggagcaacgccgcgtgagtgatgaaggttttcggatcgtaaagctctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcaca

SEQ ID NO: 220 - DNA, 950 bp, Bacillus niabensis
  modified_base (37)..(37): a, c, t, g, unknown or other
  modified_base (43)..(43): a, c, t, g, unknown or other
  modified_base (80)..(80): a, c, t, g, unknown or other
  modified_base (85)..(85): a, c, t, g, unknown or other
  modified_base (939)..(939): a, c, t, g, unknown or other
gccagcagccgcggtaatacgtaggtggcaagcgttntccggnaattattgggcgtaaagcgcgcgcaggcggttccttnaagtntgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacggggacccgcacaagcggtggagcatgtggtttaattcgaagcaacgcgaagaaccttaccaggtcttgacatcctctgctacttctagagatagaaggttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgtgaggtcgagccaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagtttgtaacacccgaagtcggtgaggtaacctttnggagccagccg

SEQ ID NO: 221 - DNA, 929 bp, Bacillus niacini
  modified_base (76)..(76): a, c, t, g, unknown or other
gccgcggtaatacgtaggtggcaagcgttgtccggaattattgggcgtaaagcgcgcgcaggcggtcctttaagtntgatgtgaaagctcacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagttcacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttacgacctccctagagatagggatttccccttcgggggacggaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgttacaatggatggtacaaagggcagcgaaaccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaac

SEQ ID NO: 222 - DNA, 1495 bp, Bacillus pocheonensis
aggacgaacgctggcggcgtgcctaatacatgcaagtcgagcgaatcattaggagcttgctcctattggttagcggcggacgggtgagtaacacgtgggcaacctgcctgtaagactgggataacttcgggaaaccggagctaataccggataatccttttcctctcatgagggaaagttgaaagatggcgtcagctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaatcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcaaggttaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgt

SEQ ID NO: 223 - DNA, 1410 bp, Bacillus pumilus
  modified_base (1399)..(1399): a, c, t, g, unknown or other
tcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttanggagccagccg

SEQ ID NO: 224 - DNA, 1411 bp, Bacillus safensis
  modified_base (1400)..(1400): a, c, t, g, unknown or other
gtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacgtcctctgacaacctctgagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttanggagccagccg

SEQ ID NO: 225 - DNA, 1522 bp, Bacillus simplex
cctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggaagccagccgcctaaggtgggacagatgattggggtgaagtcgtaacaaggtagccgtatcggaaggtgcggctgg

SEQ ID NO: 226 - DNA, 971 bp, Bacillus sonorensis
tcgagcgaaccgacgggagcttgctcccttaggttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtgccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggct

SEQ ID NO: 227 - DNA, 935 bp, Bacillus sp. 10403023 MM10403188
  modified_base (843)..(843): a, c, t, g, unknown or other
  modified_base (926)..(926): a, c, t, g, unknown or other
tcgagcggagatttgaaaagcttgcttttcaaatcttagcggcggacgggtgagtaacacgtgggcaacctgcccttgagacggggataactccgggaaaccggagctaataccggataacacatatcttcgcatgaggatatgttagaaggtggcttttagctaccactcaaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtacctgttgaataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtanggtcgcaagactgaaactcaaaggaattgacggggacccgcacaagcggtggagcatgtggtttaattcgaagcaacgcgaanaaccttacc

SEQ ID NO: 228 - DNA, 1485 bp, Bacillus sp. 2008724126
ggctcaggacgaacgctggcggcgtgcctaatacatgcaagtcgagcgaatcgaygggagcttgctccctgagattagcggcggacgggtgagtaacacgtgggcaacctgcctataagactgggataacttcgggaaaccggagctaataccggatacgttcttytctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtc

SEQ ID NO: 229 - DNA, 1495 bp, Bacillus sp. 2008724139
gttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttyatggagccagccgcctaaggtgggacagatgattggggtgaagtcg

SEQ ID NO: 230 - DNA, 1547 bp, Bacillus sp. 2_A_57_CT2
ggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttct

SEQ ID NO: 231 - DNA, 1493 bp, Bacillus sp. 7-16AIA
tggctcaggacgaacgctggcggcgtgcctaatacatgcaagtcgagcggatgacgaggagcttgctcctctgattcagcggcggacgggtgagtaacacgtgggcaacctgcctgtaagactgggataactccgggaaaccggggctaataccggataggtgatgtcttcgcatgaagagatcaggaaagatggcttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcgaatagggcggtaccgtgacggtacctaaccagaaagccacggctaactacgtgccagcagccgcggtaatacgtaggtggcaagcgttgtccggaattattgggcgtaaagcgcgcgcaggcggcttcttaagtctgatgtgaaagcccgcagctcaactgcggagggtcattggaaactgggaagcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgctacttctagagatagaaggttccccttcgggggacggagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggacggtacaaagggctgcgaaaccgcgaggtggagccaatcccagaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgcaaggagccagccgccgaaggtgggacagatgattggggtgaagtcgtaacaa

SEQ ID NO: 232 - DNA, 1503 bp, Bacillus sp. 9-3AIA
tggcaggacgaacgctggcggcgtgcctaatacatgcaagtcgagcgagtgaaacgatcagaagccttcgggtggacgatcgtggatctagcggcggacgggtgagtaacacgtaggcaacctgcctgtaagacggggataactccgggaaaccggagctaataccggatgaaccttcagctcgcatgagctggagttgaaaggtggcgcaagctaccacttacagatgggcctgcggcgcattagctagttggtgaggtaagggctcaccaaggcgacgatgcgtagccgacctgagagggtgatcggccacactgggactgagacacggcccagactcctacgggaggcagcagtagggaatcttcggcaatggacgcaagtctgaccgagcaacgccgcgtgagtgaggaaggttttcggattgtaaaactctgttgttagggaagaacaagtaccgtttgaataaggcggtaccttgacggtacctaacgagaaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactgggaaacttgagtgtaggagaggaaagcggaattccacgtgtagcggtgaaatgcgtagagatgtggaggaacaccagtggcgaaggcggctttctggcctataactgacgctgaggcgcgaaagcgtggggagcaaacaggattagataccctggtagtccacgccgtaaacgatgagtgctaggtgttaggggtttcgatacccttagtgccgacgttaacacaataagcactccgcctggggagtacggccgcaaggctgaaactcaaaggaattgacggggacccgcacaagcagtggagcatgtggtttaattcgaagcaacgcgaagaaccttaccaggacttgacatccctctgaatcctctagagatagaggcggccttcgggacagaggtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgtcctgggctacacacgtgctacaatgggcagtacaacgggtagcgaagccgtgaggtggagccaatcccataaagctgctctcagttcggattgcaggctgcaactcgcctgcatgaagccggaattgctagtaatcgcggatcagcatgccgcggtgaatacgttcccgggtcttgtacacaccgcccgtcacaccacgagagcttgtaacacccgaagtcggtgaggtaaccttttggagccagccgccgaaggtgggataggtgattggggtgaagtcgtaacaa

SEQ ID NO: 233 - DNA, 1514 bp, Bacillus sp. AP8
tagagtttgatcctggctcaggacgaacgctggcggcgtgcctaatacatgcaagtcgagcgaacggaggagagcttgctctccgaagttagcggcggacgggtgagtaacacgtgggcaacctgcctataagactgggataactccgggaaaccggggctaataccggatagttcttttctccwcatggagaaaaggggaaagatggtttcggctatcacttatagatgggcccgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggaaggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgcaaggagccagccgcctaaggtgggacagatgattggggtgaagtcgtaacaaggtagccgt

SEQ ID NO: 234 - DNA, 1402 bp, Bacillus sp. B27(2008)
  modified_base (1389)..(1389): a, c, t, g, unknown or other
agcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagttgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtanccttttaggagcc

SEQ ID NO: 235 - DNA, 1411 bp, Bacillus sp. BT1B_CT2
  modified_base (1400)..(1400): a, c, t, g, unknown or other
gtcgagcggaccgacgggagcttgctcccttaggtcagcggcggacgggtgagtaacacgtgggtaacctgcctgtaagactgggataactccgggaaaccggggctaataccggatgcttgtttgaaccgcatggttcaaacataaaaggtggcttttcgctaccacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggtttttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttnggagccagccg

SEQ ID NO: 236 - DNA, 1429 bp, Bacillus sp. GB1.1
ggggaggagagggactgctcctgagtcagcggcggacgggtgagtaacacgtgggcaacctgcctgtaagactgggataacttcgggaaaccggagctaataccggataatgcacagcctctcatgaggctatgctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcaccttgacggtacctgaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacctttggagccagccgcctaaggtggacagagatgggatcctt

SEQ ID NO: 237 - DNA, 1218 bp, Bacillus sp. GB9
  modified_base (1162)..(1162): a, c, t, g, unknown or other
ggggggagagaagggactgctcctgagtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgngctacacacgtgctacaatggatggtacaaagggctgcgagaccgcgaggtaagcg

SEQ ID NO: 238 - DNA, 1413 bp, Bacillus sp. HU19.1
agctcttcggagatcagcggcggacgggtgagtaacacgtgggcaacctgcctgtaagactgggataactccgggaaaccggagctaataccggatactatgtcaaaccgcatggtttgacattcaaagacggtttcggctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcgccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagattgatc

SEQ ID NO: 239 - DNA, 1428 bp, Bacillus sp. HU29
acggaagggagcttgctcatacgtcagcggcggacgggtgagtaacacgtgggcaacctgcctgtaagactgggataactccgggaaaccggggctaataccggataatgcttttcctcacatgagggaaagctgaaagatggcttctcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattgggat

SEQ ID NO: 240 - DNA, 1418 bp, Bacillus sp. HU33.1
gatcgctttggagtcagcggcggacgggtgagtaacacgtgggcaacctgcctgtaagactgggataactccgggaaaccggagctaataccggatactatgtcaaaccgcatggtttgacattcaaagacggtttcggctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgccggagtaactgccggcgccttgacggtacctgaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagatgattgggatg

SEQ ID NO: 241 - DNA, 1475 bp, Bacillus sp. JC6
tagagttttgatcctggctcaggacgaacgctggcggcgtgcctaatacatgcaagtcgagcggatctgagggagcttgctcccaaagattagcggcggacgggtgagtaacacgtgggcaacctgcctataagactgggataacttcgggaaaccggagctaataccggataatgcttttggacacatgtccggaagctgaaagatggcttctcgctatcacttatagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgccatccctagagatagggctttcccttcggggacataagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcgaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 242 - DNA, 1525 bp, Bacillus sp. SRC_DSF10
agagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagctcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 243 - DNA, 934 bp, Bacillus sp. SRC_DSF1
  modified_base (76)..(76): a, c, t, g, unknown or other
  modified_base (233)..(233): a, c, t, g, unknown or other
gccgcggtaatacgtaggtggcaagcgttatccggaattattgggcgtaaagcgcgcgcaggcggtttcttaagtntgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgntgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaagg

SEQ ID NO: 244 - DNA, 1526 bp, Bacillus sp. SRC_DSF2
agagtttgatcatggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcattccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccaggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 245 - DNA, 1525 bp, Bacillus sp. SRC_DSF6
agagtttgatcatggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagctacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcattccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtaaccgtagcggccgc

SEQ ID NO: 246 - DNA, 1552 bp, Bacillus sp. oral taxon F26
agagtttgatcctggctcaggacgaacgctggcggcgtgcctaatacatgcaagtcgagcggagatttaaaagcttgcttttaaatcttagcggcggacgggtgagtaacacgtgggcaacctgccctgtagactgggataacttcgggaaaccgaagctaataccggataatcgaagggacctcatggttctttagtaaaagttgggtttacctaacactacaggatgggcccgcgtcgcattagctagttggtagggtaatggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtactgttcaaatagggcagtaccttgacggtacctaacgagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccccatgacctctctagagatagagatttcccttcggggacatgggtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacctaagagtttgcggagcaatcttgcttcgtaagcgttgacctaggagccagccgcctaaggtgggacagatgattggggtgaagtcgtaacaaggtagccgt

SEQ ID NO: 247 - DNA, 1478 bp, Bacillus sp. oral taxon F28
agagtttgatcctggctcaggacgaacgctggcggcgtgcctaatacatgcaagtcgagcgcgggaagcttgcggaatccttcgggaggaagtgagcggaccgagcggcggacgggtgagtaacacgtgggcaacctgcccgtaagacggggataaccccgggaaaccggggctaataccggataggtgacctttctgcatggaggggtcatgaaaggcggcggaagccgtcgcttacggaggggcccgcggcgcattagctagttggtgagggaagggctcaccaaggcgacgatgcgtagccggcctgagagggtgaacggccacactgggactgagacacggcccagactcctacgggaggcagcagtagggaatcttccgcaatggacggaagtctgacggagcaacgccgcgtgagtgaggaaggccttcgggtcgtaaagctctgttgttcgtgaagaaggggttggccaggaaatgggccgacattgacggtagcgaaccagaaagccccggctaactacgtgccagcagccgcggtaacacgtagggggcaagcgttgtccggaatgattgggcgtaaagggcgcgcaggcggcctcttaagtctgatgtgaaagcccacggctcaaccgtggagggacattggaaactggggggcttgagtgcaggagaggggagtggaattccacgtgtagcggtgaaatgcgtagagatgtggaggaacaccagtggcgaaggcggctctctggcctgtgactgacgctgaggcgcgaaagcgtggggagcgaacaggattagataccctggtagtccacgccgtaaacgatgagtgctaggtgttaggggggagcaccccttagtgctgaagtcaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccctctgatgggttcagagatggaccgttccttcgggacagaggagacaggtggtgcatggttgtcgtcagctcgtgtcgtgagatgttgggttaagtcccgcaacgagcgcaacccttgacctttgttgccagcattaagttgggcactcagaggtgactgccggtgacaaaccggaggaaggtggggatgacgtcaaatcatcatgcccctgatgacctgggcgacacacgtgctacaatgggcggtacagagggcagcgaagccgcgaggcggagcgaatcccagaaagccgctctcagttcggattgcaggctgcaactcgcctgcatgaaggaggaattgctagtaatcgcggatcagcatgccgcggtgaatccgttcccgggccttgtacacaccgcccgtcacaccacgagagtctgtaacacccgaagtcggtgaggcaaccggaaggagccagccgcc

SEQ ID NO: 248 - DNA, 1507 bp, Bacillus sp. oral taxon F79
  modified_base (880)..(880): a, c, t, g, unknown or other
agagtttgatcctggctcaggacgaacgctggcggcgtgcctaatacatgcaagtcgagcgcttgcatattgaaagcttgctttcaatatgcttgagcggcggacgggtgagtaacacgtgggcaacctgcctgtaagactgggataacttcgggaaaccggagctaataccggataatgcttttgaacacatgttcgaaagctgaaagatggtttcggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaancactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaa

SEQ ID NO: 249 - DNA, 1405 bp, Bacillus sp. tc09
tgcagtcgagcgaatggattaagagcttgctcttatgaagttagcggcggacgggtgagtaacacgtgggtaacctgcccataagactgggataactccgggaaaccggggctaataccggataacattgaaccgcatggttcgaaattgaaaggcggcttcggctgtcacttatggatggacccgcgtcgcattagctagttggtgaggtaacggctcaccaaggcaacgatgcgtagccgacctgagaggggtcggccacactgggactgagacacggcccagactcctacgggaggcagcagtagggaatcttccgcaatggacgaaagtctgacggagcaacgccgcgtgagtgatgaaggctttcgggtcgtaaacctgttgttagggaagaacaagtgctagttgaataagctggcaccttgacggtacctaaccagaaagccacggctaactacgtgccagcagccgcggtaatacgtaggtggcaagcgttatccggattttgggcgtaaagcgcgcgcaggtggtttcttaagtctgatgtgaaagcccacggctcaaccgtggagggtcattggaaactgggagacttgagtgcagaagaggaaagtggaattccatgtgtgcgggaaatgcgtagagatatggaggaacaccagtggcgaaggcgactttctggtctgtaactgacactgaggcgcgaaagcgtggggagcaaacaggattagataccctggtagtccacgccgtaacgatagtgctaagtgttagagggtttccgccctttagtgctgaagttaacgcattaagcactccgcctggggagtacggccgcaagggtgaaacttaaaggaattgacgggggcccgcaccagcgtggagctgtggtttaatttgaagcaacgggaagaaccttaccaggttttgacatcctttgacaaccctagagataggggttttcctttgggagcagagtgacaggtggtgcatggttgttgtcagccgtgttggagatgttgggttaagtcccgcaacgagcgcaacccttgattttagttgccatcattaagttgggcactttaaggtgactgccggtgacaaaccggaggaaggtggggaagacgtcaaacatcatgcccttatgacctgggctacccacgtggtacaatggacggtacaaagaggtgcaagaccccgagggggagctaatttcataaaaccgttttcagtttggattgtagggtgcaacttgcctcatgaagccgaatcgctagtaatcgcggatcagcctgccgcggggaatacgttcccgggccttgtacaccccccccgtcaccccccgagagtttgtaacacccgaagtcggtggggtaacctttttgagccagccgctaaggtg

SEQ ID NO: 250 - DNA, 725 bp, Bacillus sp. zh168
  modified_base (105)..(106): a, c, t, g, unknown or other
  modified_base (112)..(112): a, c, t, g, unknown or other
  modified_base (134)..(135): a, c, t, g, unknown or other
cttcggctaccacttacagatggacccgcggcgcattagctagttggtgaggtaacggctcaccaaggcaacgatgcgtagccgacctgagagggtgatcggccnnactggnactgagacacggcccagactcnnacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcc

SEQ ID NO: 251 - DNA, 1430 bp, Bacillus sphaericus
taatacatgcaagtcgagcgaacagagaaggagcttgctcctttgacgttagcggcggacgggtgagtaacacgtgggcaacctaccttatagtttgggataactccgggaaaccggggctaataccgaataatctgtttcacctcatggtgaaatattgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccga

SEQ ID NO: 252 - DNA, 1497 bp, Bacillus sporothermodurans
ctggcggcgtgcctaatacatgcaagtcgagcgaacttgatgggagcttgctccctgagagttagcggcggacgggtgagtaacacgtgggtaacctgcctgtaagactgggataactccgggaaaccggggctaataccggataacttttttcttcgcatgaaggagaattgaaagacggctttaagctaccacttacagatggacccgcggcgcattagctagttggtgaggtaacggctcaccaaggcgacgatgcgtagccgacttgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtatcgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggctcaaccgtggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctcttgacctccctagagatagggatttcccttcggggacaagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgctagaccgcgaggttacgccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaag

SEQ ID NO: 253 - DNA, 965 bp, Bacillus subtilis
  modified_base (857)..(857): a, c, t, g, unknown or other
  modified_base (919)..(919): a, c, t, g, unknown or other
  modified_base (929)..(929): a, c, t, g, unknown or other
  modified_base (938)..(938): a, c, t, g, unknown or other
ggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacnggggcccgcacaagcggtggagcatgtggtttaattcgaagcaacgcgaagaacccttaccnggtcttgacntcctctganatcctagagataggacgtccccttcgg

SEQ ID NO: 254 - DNA, 1412 bp, Bacillus thermoamylovorans
tcgagcgaaccaataagaagcttgctttttgttggttagcggcggacgggtgagtaacacgtgggtaacctgcctgtaagaccgggataactccgggaaaccggtgctaataccggatagattatctttccgcctggagagataaggaaagatggcttttgccatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtatcggaggaaatgccggtaccttgacggtacctgacgagaaagccacggctaactacgtgccagcagccgcggtaatacgtaggtggcaagcgttgtccggatttattgggcgtaaagcgcgcgcaggcggtcctttaagtctgatgtgaaatcttgcggctcaaccgcaagcggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatctcctgaccgccctggagacagggtcttcccttcggggacaggatgacaggtggtgcatggttgtcgtcagctcgtgtcgtgagatgttgggttaagtcccgcaacgagcgcaacccttggttctagttgccagcattcagttgggcactctagagcgactgccggcgacaagtcggaggaaggtggggatgacgtcaaatcatcatgccccttatgacctgggctacacacgtgctacaatggatggtacaaagggcagcgaagcggcgacgcatgagcgaatcccagaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccgtaaggagccagccg

SEQ ID NO: 255 - DNA, 1554 bp, Bacillus thuringiensis
ttattggagagtttgatcctggctcaggatgaacgctggcggcgtgcctaatacatgcaagtcgagcgaatggattaagagcttgctcttatgaagttagcggcggacgggtgagtaacacgtgggtaacctgcctataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttct

SEQ ID NO: 256 - DNA, 1545 bp, Bacillus weihenstephanensis
agagtttgatcctggctcaggatgaacgctggcggcgtgcctaatacatgcaagtcgagcggatggattaagagcttgctcttatgaagttagcggcggacgggtgagtaacacgtgggtaacctacccataagactgggataactccgggaaaccggggctaataccggataatattttgaactgcatagttcgaaattgaaaggcggcttcggctgtcacttatggatggacccgcgtcgcattagctagttggtgaggtaacggctcaccaaggcgacgatgcgtagccgacctgagagggtgatcggccacactgggactgagacacggcccagactcctacgggaggcagcagtaggggatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaactctagagatagagcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctccttt

SEQ ID NO: 257 - DNA, 1388 bp, Bacteroidales bacterium ph8
gcagcatgaaagtagcaatacttttgatggcgaccggcggacgggtgcgtaacgcgtatgcaacctaccctttacagggggataacactgagaaatcggtactaataccccataatattccgggaggcatctttcggagttgaaagctttggtggtaaaggatgggcatgcgttgtattagctagttggtaaggtaacggcttaccaaggcgacgatacatagggggactgagaggttaaccccccacattggtactgagacacggaccaaactcctacgggaggcagcagtgaggaatattggtcaatggacggaagtctgaaccagccatgccgcgtgcaggaagacggctctatgagttgtaaactgcttttgtacgagggtaaacgcagatacgtgtatctgcctgaaagtatcgtacgaataaggatcggctaactccgtgccagcagccgcggtaatacggaggatccaagcgttatccggatttattgggtttaaagggtgcgtaggcggtttagtaagtcagcggtgaaattttggtgcttaacaccaaacgtgccgttgatactgctgggctagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgatagctcgttgtcggcgatacacagtcggtgactaagagaaatcgataagctatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctactgatagttgccatcagagcgtttgagcgatcaaacaagctgggcactctatcgggactgccggtgtaagccgagaggaaggtggggatgacgtcaaatcagcacggcccttacgtccggggcgacacacgtgttacaatggtaggtacagagggcagccacccagtgatggggagcgaatctcgaaagcctatctcagttcggattggaggctgaaactcgcctccatgaagttggattcgctagtaatcgcgcatcagccatggcgcggtgaatacgttcccgggccttgtacacaccgcccgtcaagccatgggagttgggggtgcctgaagttcgtgaccgag

SEQ ID NO: 258 - DNA, 1285 bp, Bacteroidales genomosp. P1
atgaacgctagcggcaggcttaacacatgcaagtcgagggaccggcgtaagggtgcgtaacgcgtgagcaacctgcccgtatcagggggataaccgatggaaacgtcgcctaataccccataataaaagtcagatacggatgggctcgcgtgacattagctagttggtgtggtaacggcacaccaaggcaacgatgtctaggggttctgagaggaagaccccccacactggaactgagacacggtccagactcctacgggaggcagcagtgaggaatattggtcaatgggcggaagcctgaaccagccatgccgcgtgaaggaataaggtctatggatcgtaaacttcttttgagcgggagcatgagagtaccgttcgaataagcatcggctaactccgtgccagcagccgcggtaatacggaggatgcaagcgttatccggatttattgggtttaaagggtgcgtaggccgttgtgcaagtcagaggtgaaatcgcggggctcaaccccgtgtctgcctttgatactgtatgacttgaatgttgttgccgtgtgaggaatgagtagtgtagcggtgaaatgcatagatattactcagaacaccgattgcgaaggcatctcacgaaacaaattgacgctgaggcacgaaagcgtgggtatccaacaggattagataccctggtagtccacgctgtaaacgatgataactaaccgtcggcgagtcggtggccaagcgaaagcgataagttatccacctggggagtacgaccgcaaggttgaaactcaaaggaattgacgggggcccgcacaagcggaggaacatgtggtttaattcgatgatacgcgaggaaccttacccgggctcgaacggtcgaggtgctgcatggttgtcgtcagctcgtgtcgtgagatgttggctcaagtgccataacgagcgcaacccttgtcattagttgccatcggccgggctctctaatgagactgccaccgcaaggtggaggaaggagtggatgacgtcaaatcagcacggcccttacgtccggggcgacacacgtgttacaatggtgaccagagggtagccagccggcgacggcgcgcaaatctcagtcatctcagttcggatggagtctgcaacccgactccagaagctggattcgctagtaatcgcgcatcagccatggtgcggtgaatacgttcccgggccttgtacacaccgcccgtcaagccatgaaagccgagggcgcctgaagtccggccggcctaaggcgaacttggtaattggggc

SEQ ID NO: 259 - DNA, 1289 bp, Bacteroidales genomosp. P2 oral clone MB1_G13
gatgaacgctagcggcaggcttaacacatgcaagtcgagggaccggcgaaagggtgcgtaacgcgtgagtaacatacccgttacagagggatagtcgatggaaacgtcgtataatacctcatagttaaatgaggtaacggagtggctcgcgtcccattagttagttggcgtggtaacggcacaccaagacaacgatgggtaggggttctgagaggaaggtcccccacactggaactgagacacggtccagactcctacgggaggcagcagtgaggaatattggtcaatgggcggaagcctgaaccagccatgccgcgtgcaggaatagatcctatgggacataaactgcttttgatactgagcatgagagtaagtatcgaataagcatcggctaactccgtgccagcagccgcggtaatacgggggatgcaagcgttatccggaattattgggtttaaagggtgcgtaggctgtgcggtgcgtctgtggttaaaggcctctgcttaacggagcgtatgccatagaaacggccgtgcttgagagtgattgccgtgggaggaatgtgtggtgtagcggtgaaatgcatagatatcacacagaacaccgattgcgaaggcatctcacgaagtcatctgacgctgaagcacgaaagcgtgggaatcaaacaggattagataccctggtagtccacgctgtaaacgatgataactaaccgccggcgatcggtggctaagcgaaagcgataagttatccacctggggagtacgaccgcaaggttgaaactcaaaggaattgacgggggcccgcacaagcggaggaacatgtggtttaattcgatgatacgcgaggaaccttacccgggctcgaacggtcgaggtgctgcatggttgtcgtcagctcgtgccgtgaggtgtcggcttaagtgccataacgagcgcaacccttgcctgctgttaccaacgtacggggactcagcagggactgccaccgtaaggtggaggaagggggggatgacgtcaaatcagcacggcccttacgtccggggcgacacacgtgtcacaatggcggtcagagagttgcttgacagtgatgtttggctaatctataccgtctcagttcggatggagtctgcaacccgactccagaagctggattcgctagtaatcgcgcatcagccatggcgcggtgaatacgttcccgggccttgtacacaccgcccgtcaagccatggaagtcattggcgcctgaagcttgtccgagcgagcgaaggcgaaaatggtaactggggc

SEQ ID NO: 260 - DNA, 1282 bp, Bacteroidales genomosp. P3 oral clone MB1_G34
  modified_base (908)..(908): a, c, t, g, unknown or other
gatgaacgcttgcggcaggcataatacatgcaagtcgaacgagtggcggatgggtgagtaacgcgtatgcaacctacctcacaccgagaacaagcgactgaaaagttgaatatctcgtgatgatagttggtgtgagatgggcatgcgtatcattagctagttggcggggtaatagcccaccaaggcgacgatgattcgggggcctgagagggtggtcccccacactgggactgagacacggcccagactcctacgggaggcagcagtagggaatatcggtcaatgggcggaagcctgaaccagccatgccgcgtgatggatgacggccttagggttgtaaacatcttttctactagaggacgactgtatagtaggaataaggatcggctaactccgtgccagcagccgcggtaatacggaggattcgagcgttatccggatttactgggtttgaagggtgcgcaggcgggctcttaagtcagcggtgaaatgtccgggcttaccctgggccttgccgttgatactgggagtcttggataagataaggacggcggaatgcgtagtgtagcggtgaaatgcttagatattacgtagaagaccgattgcgaaggcagctgtctgggtctatcgacgctcaagcacgaaagcgtgggtagcgaacaggattagataccctggtagtccacgccgtaaacgatgatcactcgctcttggcgtgtcaggggctaagcgaaagcgttaagtgatccacctggggagtacgaccgcaaggttgaaactcaaaggaattgacgggggcccgcacaagcggaggaacatgtggtttaattcgatgatacgcgaggaaccttacctgggctagaacggtcgaggtgctgcatggttgtcgtcagctcgtgccgtgaggngtcgggttaagtcccataacgagcgcaacccttatcgtcagttaccatcaattggggactctggcgagactgccggtgcaaaccggaggaaggtggggatgacgtcaaatcagcacggcccttacgtccagggcgacacacgtgttacaatgggtagcggagagttgccagccagcgatggtgagctaatctatctatcctcagttcggacggagtctgcaactcgactccggaagctggattcgctagtaatcgcgcatcagccatggcgcggtgaatacgttcccgggccttgtacacaccgcccgtcaagccatgaaagtcatgggtgcctgaagttcgtcgcaacctagggcaaacttggtgattagggc

SEQ ID NO: 261 - DNA, 1286 bp, Bacteroidales genomosp. P4 oral clone MB2_G17
gatgaacgcttgcggcaggcttaatacatgcaagtcgaacgagtggcggatgggtgagtaacgcgtatgcaacctacctcgtgtcgagaaaaagtcgactgaaaagtcgattaaagtttcgtagtgatagttggcgcgagatgggcatgcgtatcattagctagttggtagggtaacggcctaccaaggcgacgatgattaggggttctgagagggaggtcccccacactgggactgagacacggcccagactcctacgggaggcagcagtagggaatattggtcaatgggcggaagcctgaaccagccatgccgcgtgatggacgacggccttcgggttgtaaacatcttttctgctagaggatgactgtatagcaggaataaggatcggctaactccgtgccagcagccgcggtaatacggaggatccgagcgttatccggatttactgggtttaaagggtgcgcaggcgggctcttaagtcagtggtgaaaagcctaggcttaccctaggtcgtgccattgatactgggagtcttggataagataaggaaggcggaatgcgtagtgtagcggtgaaatgcttagatattacgtagaagaccgattgcgaaggcagctttctgggtctatcgacgctcaagcacgaaagcgtgggtagcgaacaggattagataccctggtagtccacgccgtaaacgatgatcactcgctcttggcgtgtcaggggccaagcgaaagcgttaagtgatccacctgggagtacggccgcaaggctgaaactcaaaggaattgacgggggcccgcacaagcggaggaacatgtggtttaattcgatgatacgcgaggaaccttacctgggctagaactgcagaggtgctgcatggttgtcgtcagctcgtgccgtgaggtgtcgggttaagtcccataacgagcgcaacccctatcgtcagttaccatcagctggggactctggcgagactgccggtgcaaaccggaggaaggtggggatgacgtcaaatcagcacggcccttacgtccagggcgacacacgtgttacaatgggtagcagcgagttgccaaccagcaatggtgcgctaatctatactaccctcagttcggacggagtctgcaactcgactccggaagctggattcgctagtaatcgcgcatcagccatggcgcggtgaatacgttcccgggccttgtacacaccgcccgtcaagccatgaaagtcgtgggtgcctgaagttcgtagcgacctaaggcaaactcaatgattagggc

SEQ ID NO: 262 - DNA, 1265 bp, Bacteroidales genomosp. P5 oral clone MB2_P04
gcataacacatgcaagtcgagggaccggcggatgggtgagtagcgcgtacgtaacctaccttgtacagtgggataggcattggaaacggtgtataataccacgtaatggaagttggtataagatgggcgtgcgtaggattagatagatggtagggtaaaggcttaccatgtctatgatctttaggggttctgagaggaaggtcccccacattgcaactgagatacggtgcaaactcttacgggaggcagcagtgaggaatattggtcaatgggcggaagcttgaaccagccataccgcgtgcaggaaggcggcctatgggttgtaaactgcttttatatttgaataggaaattagggtacgaataagtatcggctaactccgtgccagcagccgcggtaatacggaggatacgagcgttgtccggatttattgggtttaaagggtgcgtaggcggttaattaggtctatggtaaaatagttatgcttaacatgattatgctgtggataccggttggctagaatataagtggcgtaggcggaatgaagcgagtagaggtgacattcatagatatgctttggaacaccgttcgcgtaggcggcttacgataattgacgctgaggcacgagagcgtgggtatcgaacagaattagatactctggtagtccacgctgtaaacgatgataactatatgtcggcgtgtcggtgtaggagtgaaagcgataagttatccacctggggagtacgattgcaaggttgaaactcaaaggaattgacgggggcccgcacaagcggaggagcatgtggtttaattcgatgatacgcgaggaaccttacccgggcttgaacgtgcgaggtgctgcatggttgtcgtcagctcgtgccgtgaggtgtcaggttaagtcctataacgagcgtaacccttgttgatagttaccagcgcgtggggactctattgatactgccggtgtaagccggaggaagggggggatgacgtcaaatcagcacggcccttacgtccggggcgacacacgtgctacaatggttaacagagggcagttatacagagatgtaacacgaatctttttagtcatagtacggatggagtctgcaactcgacttcagaagatggattcgctagtaatcgcagatcagccatgctgcggtgaatacgttcccgggccttgtacacaccgcccgtcaagccatgggagttggtggtacctaaagagcgtagcgtttaagggtaatgctaataactggggc

SEQ ID NO: 263 - DNA, 1287 bp, Bacteroidales genomosp. P6 oral clone MB3_C19
gatgaacgcttgcggcaggcttaatacatgcaagtcgaacgagtggcggatgggtgagtaacgcgtatgcaaccttcctcacaccgagaaaaagtcgactgaaaagttgaataaagtctcgtgatgatagttggtgtgagatgggcatgcgtatcattagctagttggtagggtaacggcttaccaaggcgacgatgattagggggcctgagagggtggtcccccacactgggactgagacacggcccagactcctacgggaggcagcagtagggaatattggtcaatgggcggaagcctgaaccagccatgccgcgtgatggatgacggccttagggttgtaaacatcttttctgctagaggacgactgtatagcaggaataaggatcggctaactccgtgccagcagccgcggtaatacggaggattcgagcgttatccggatttactgggtttaaagggtgcgcaggcgggctcttaagtcagcggtgaaatgtctgggcttaccctaggaattgccgttgatactgggagtcttggataagataaggacggcggaatgcgtagtgtagcggtgaaatgcttagatattacgtagaagaccaattgcgaaggcagctatctgggtctatcgacgctcaagcacgaaagcgtggggagcaaacaggattagataccctggtagtccacgccgtaaacgatgatcactcgctcttggcgtgtcaggggccaagcgaaagcgttaagtgatccacctggggagtacggccgcaaggctgaaactcaaaggaattgacgggggcccgcacaagcggaggaacatgtggtttaattcgatgatacgcgaggaaccttacctgggctagaacggtcgaggtgctgcatggttgtcgtcagctcgtgccgtgaggtgtcgggttaagtcccataacgagcgcaacccttatcgtcagttaccatcaattggggactctggcgagactgccggtgcaaaccggaggaaggtggggatgacgtcaaatcagcacggcccttacgtccagggcgacacacgtgttacaatgggtagcagagagttgccagccagcgatggtgagctaatctattctaccctcagttcggatggagtctgcaactcgactccagaagctggattcgctagtaatcgcgcatcagccatggcgcggtgaatacgttcccgggccttgtacacaccgcccgtcaagccatgaaagtcgtgggtgcctgaagttcgtagcgacctaaggcaaactcgatgattagggc

SEQ ID NO: 264 - DNA, 1267 bp, Bacteroidales genomosp. P7 oral clone MB3_P19
gcttaacacatgcaagtcgagggaccggcggatgggtgagtaacgcgtatgcaatctaccttttacccggggatagcccatggaaacgtggattaatacccgatgcataaagtcggtaagagatgagcatgcgttccattaggaagttggtaaggtaacggcttaccaatccgatgatggatgggggttctgagaggaaggtcccccacactggaattgagatacggtccagactcctacgggaggcagcagtgaggaatattggtcaatggtcgtaagactgaaccagccaagtcgcgtgaaggaaactgcctatgggttttcaacttcttttgtcagggaagatgccggtacctgacgaataaggatcggctaacgccgtgccagcagccgcggtaatacggaggatccgagcgttatccggatttattgggtttaaagggtgcttaggcggcatattaagttagtggtcaaatggtccggctcaaccggatttcgccattaaaactgatgtgctagagattaaacgaggtaggcggaataagttaagtagcggtgaaatgcatagatataacttagaactccgatagcgaaggcagcttaccaggctatctgacgctgaatcacgagagcgtgggtatcgaacaggattagataccctggtagtccacgccgtaaacgatgctcaccggctctatgcgtgtatggggctaatagaaataattaagtgagccacctggggagtacgtcggcaacgatgaaactcaaaggaattgacgggggcccgcacaagcggaggaacatgtggtttaattcgatgatacgcgaggaaccttacccgggtttaaatgtacaaggtgctgcatggttgtcgtcagctcgtgccgtgaggtgtcgggttaagtcccataacgagcgcaacccttatgattagttgctaacggccgagcactctattcacactgccaccgtaaggtggaggaaggaggggatgatgtcaaatcagcacggcccttatatccggggctacacacgtgttacaatggtcggcagagggttgcatttacgagagtaacagctaatcccttcggtcacagttcggatggagtctgcgactcgactccagaagttggattcgctagtaatcgcacatcagccatggtgcggtgaatacgttcccgggccttgtacacaccgcccgtcaagccatgggagctgagggtgcctgaagttcgtagcgacctagggcaaacttggtaactggggc

SEQ ID NO: 265 - DNA, 1292 bp, Bacteroidales genomosp. P8 oral clone MB4_G15
gatgaacgctagcggcaggcctaacacatgcaagtcgagggaccggcgaacgggtgcgtaacgcgtgaacaacttgccggacacagggggataatcgtcggaaacgtcgtctaatatcccataacgaaaggcggtgtctgataggttcgcgtgacattagctagtcggtggggcaacggcccaccgaggcgacgatgtctaggggttctgagaggaaggccccccacactgggactgagacacggcccagactcctacgggaggcagcagtgagggatattggacaatgggcggaagcctgatccagccatgccgcgtgaaggaataaggcctatgggtcgtaaacttcttttgacgcagagcatgagagtatgcgtcgaataagcatcggctaactccgtgccagcagccgcggtaatacggaggatgcgagcgttatccggatttattgggtttaaagggtgcgtaggctgttggataagtcagcggtgaaatcaccacgcttaacgtgttgtgtgccgttgaaactgtctggcttgaatgcgctcgtcgtgagaggaatgtgtggtgtagcggtgaaatgcatagatatcacacagaacaccgattgcgaaggcatctcacgagagcgattgacgctgatgcacgaaagcgcgggtatcgaacaggattagataccctggtagtccgcgctgtaaacgatgatgactaactgttggttgatcagtggtcaagcgaaagcgttaagtcatccacctggggagtacggccgcaaagctgaaactcaaaggaattgacgggggcccgcacaagcggaggaacatgtggtttaattcgatgatacgcgaggaaccttacccgggctcgaacggtcgaggtgctgcatggttgtcgtcagctcgtgccgtgaggtgtcggcttaagtgccataacgagcgcaacccttgccgtcagttgccatcagctggggactctgtcgggactgccaccgcaaggtggaggaagggggggatgacgtcaaatcagcacggcccctacgtccggggctacacacgtgttacaatggcgaccagaggggtgccacccggtgacggggcgccgatctccgtcgtctcagttcggatggagtctgcaacccgactccagaagctggattcgctagtaatcgcacatcagccatggtgcggtgaatacgttcccgggccttgtacacaccgcccgtcaagccatgagagccaggggcgcctgaagcgcgtaccggagcgttcaagggcgaaccaggtgattggggc

SEQ ID NO: 266 - DNA, 1495 bp, Bacteroides acidifaciens
tatcatggctcaagatgaacgctagctacaggcttaacacatgcaagtcgaggggcagcatgaaagtttgcttgcaaacttttgatggcgaccggcgcacgggtgagtaacacgtatccaacctgcctcatactcggggatagcctttcgaaagaaagattaatacccgatgtcatagtcctaccgcatgatgggattattaaagaatttcggtatgggatggggatgcgttccattagttagttggcggggtaacggcccaccaagacaacgatggataggggttctgagaggaaggtcccccacattggaactgagacacggtccaaactctacgggaggcagcagtgaggaatattggtcaatggacgagagtctgaaccagccaagtagcgtgaaggatgactgccctatgggttgtaaacttcttttatatgggaataaaatgttccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactggactgcaactgacactgaggctcgaaagtgtgggtatcaaacaggattagataccctggtagtccacacagtaaacgatgaatactcgctgtttgcgatatacggcaagcggccaagcgaaagcattaagtattccacctggggagtacgccggcaacggtgaaactcaaaggaattgacgggggccgcacaagcggaggaacatgtggtttaattcgatgatacgcgaggaaccttacccgggcttaaattgcacctgaataatgtggaaacatgttagccgtaaggcaggtgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatgggaggtacagaaggccgctacctggcgacaggatgccaatccccaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaagatcgtcctagggtaaaactggtaattggggctaagtcgtaacaaggtagccgtaccggaaggtgcg

SEQ ID NO: 267 - DNA, 1456 bp, Bacteroides barnesiae
tcaggatgaacgctagctacaggcttaacacatgcaagtcgaggggcagcgggaagtcagcttgctgactttgccggcgaccggcgcacgggtgagtaacacgtatccaaccttccgcatactctggaatagcctttcgaaagaaagattaatgcccgatggtatcaagagattgcatgatatctcgaataaagattcatcggtatgcgatggggatgcgttccattaggcagttggcggggtaacggcccaccaaaccgacgatggataggggttctgagaggaaggtcccccacattggaactgagacacggtccaaactcctacgggaggcagcagtgaggaatattggtcaatgggcgagagcctgaaccagccaagtagcgtgaaggatgactgccctacgggttgtaaacttcttttataagggaataaagttctctacgtgtagagttttgtatgtaccttatgaataagcatcggctaactccgtgccagcagccgcggtaatacggaggatgcgagcgttatccggatttattgggtttaaagggagcgtagacggcggtttaagtcagctgtgaaatggtgcggctcaaccgtagcactgcagttgaaactggacggcttgagtgcagttgaggcaggcggaattcgtggtgtagcggtgaaatgcttagatatcacgaagaaccccgattgcgaaggcagcctgctaagctgcaactgacgttgaggctcgaaagtgtgggtatcaaacaggattagataccctggtagtccacacggtaaacgatggatactcgctgttggcgatatactgtcagcggccaagtgaaaacgttaagtatcccacctggggagtacgccggcaacggtgaaactcaaaggaattgacgggggcccgcacaagcggaggaacatgtggtttaattcgatgatacgcgaggaaccttacccgggcttgaattgcagacgaatcatccggagacggatgagccgcaaggcgtctgtgaaggtgctgcatggttgtcgtcagctcgtgccgtgaggtgtcggcttaagtgccataacgagcgcaaccctttccgccggttactaacaggtgatgctgaggactccgacggtactgccatcgtaagatgtgaggaaggtggggatgacgtcaaatcagcacggcccttacgtccggggctacacacgtgttacaatggggggtacagaaggcagcgaccgggcgaccggaagcgaatccctaaagcccctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaaccggtaattggggctaa

SEQ ID NO: 268 - DNA, 1383 bp, Bacteroides caccae
tcgaggggcatcagtttggtttgcttgcaaaccaaagctggcgaccggcgcacgggtgagtaacacgtatccaacctgcctcatactcggggatagcctttcgaaagaaagattaatatccgatagcatatatttcccgcatgggttttatattaaagaaattcggtatgagatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgcgagtctgaaccagccaagtagcgtgaaggatgactgccctatgggttgtaaacttcttttatatgggaataaagtggtccacgtgtggatttttgtatgtaccatatgaataaggatcggctaactccgtgccagcagccgcggtaatacggaggatccgagcgttatccggatttattgggtttaaagggagcgtaggcggattgttaagtcagttgtgaaagtttgcggctcaaccgtaaaattgcagttgatactggcagtcttgagtgcagtagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaattatggggaaacccatacgccgcaaggcatttgtgggtgaaatgcttagttgtcaccaagtcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgccaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 269 - DNA, 1377 bp, Bacteroides cellulosilyticus
  modified_base (24)..(24): a, c, t, g, unknown or other
tcgaggggcagcatgacctagcantaggttgatggcgaccggcgcacgggtgagtaacacgtatccaacctaccggttattccgggatagcctttcgaaagaaagattaataccggatagtataacgagaaggcatctttttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaattcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatctgaataatttggaaacagattagccgtaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtccgtaaccgcaag

SEQ ID NO: 270 - DNA, 1531 bp, Bacteroides clarus
ttacaatgaagagtttgatcctggctcaggatgaacgctagctacaggcttaacacatgcaagtcgaggggcagcggggttgaagcttgcttcaaccgccggcgaccggcgcacgggtgagtaacacgtatccaacctgccgataactccgggatagcctttcgaaagaaagattaataccggatggcatagttttcccgcatggaataactattaaagaatttcggttatcgatggggatgcgttccattaggcagttggcggggtaacggcccaccaaaccgacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagttagccacgtgtggttttttgcatgtaccgtatgaataaggatcggctaactccgtgccagcagccgcggtaatacggaggatccgagcgttatccggatttattgggtttaaagggagcgtaggcggggtattaagtcagttgtgaaagtttgcggctcaaccgtaaaattgcagttgatactggtatccttgagtgcagcagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgttggcgatacaatgtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttgaattgcaactgacggaattggaaacagttctttcttcggacagttgtgaaggtgctgcatggttgtcgtcagctcgtgccgtgaggtgtcggcttaagtgccataacgagcgcaacccttatcgatagttaccatcaggtcatgctggggactctatcgagactgccgtcgtaagatgtgaggaaggtggggatgacgtcaaatcagcacggcccttacgtccggggctacacacgtgttacaatggggggtacagaaggcagctacacggcgacgtgatgctaatccccaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaaggagcgtcctagggtaaaactggtgattggggctaagtcgtaacaaggtagccgtaccggaaggtgcggctggaacacctcctttct

SEQ ID NO: 271 - DNA, 1489 bp, Bacteroides coagulans
ggctcaggacgaacgctggcggcgtgcttaacacatgcaagtcgaacgatgaagaaaagaatcgaagcttcggcagaaattcatttcggattagtggcagacgggtgagtaacgcgtgagcaacctacctcttacaaagggatagcctcgggaaaccgggattaataccatataacattgcgacgaagcatttcgatgcaatcaaagctacggcggtaagagatgggctcgcgtcccattaaccagatggtgaggtaacggctcaccatagtaacgatgggtaaccggcctgagagggtgaacggtcacactggaactgagacacggtccagactcctacgggaggcagcagtggggaatattgcacaatggagggaactctgatgcagcgacgccgcgtgagtgatgaaggaattcgtttcgtaaaactctgttctatgggaagaaaaggactgtaccataggagaaagctccggctaaatacgtgccagcagccgcggtaatacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacaggattagataccctggtagtccacgccgtaaacgatgagtgctaggtgttgggggtcaaacctcggtgccgcaagcaaacgcaataagcactccgcctggggagtacgtgcacaagcatgaaactcaaaggaattgacggggacccgcacaagcagcggagcatgtggtttaattcgtggctacgcgaagaaccttaccagggcttgacatatatatgaggggacatagagatatgaaaccagtaagagcttgctcttaacatatatacaggtggtgcatggttgtcgtcagctcgtgtcgtgagatgttgggttaagtcccgcaacgagcgcaacccttgcaattagttactaacagatcatgctgaggactctaattggactgccgatgataaatcggaggaaggtggggatgacgtcaaatcatcatgccctttatgtcctgggctacacacgtgctacaatggtcggaacaaagaggagcgaaatggtgacatcaagcaaatctcaaaaaaccgatcccagttcggattgtactctgcaactcgagtacatgaagtcggagttgctagtaatcgcggatcagaatgccgcggtgaatgcgttcccgggtcttgtacacaccgcccgtcacaccatggaagttggcaatacccgaagccgatggcctaaccgcaaggaaggagtcgtcgaaggtagggtcaatgactggggtgaagtcgtaacaaggtaacc

SEQ ID NO: 272 - DNA, 1532 bp, Bacteroides coprocola
ttacaatgaagagtttgatcctggctcaggatgaacgctagctacaggcttaacacatgcaagtcgaggggcagcatgaacttagcttgctaagtttgatggcgaccggcgcacgggtgagtaacacgtatccaaccttccgtttactcagggatagcctttcgaaagaaagattaatacctgatagtatggtgagattgcatgatggcaccattaaagatttattggtaaacgatggggatgcgttccattaggtagtaggcggggtaacggcccacctagcctgcgatggataggggttctgagaggaaggtcccccacattggaactgagacacggtccaaactcctacgggaggcagcagtgaggaatattggtcaatgggcgagagcctgaaccagccaagtagcgtgaaggatgaaggtcctacggattgtaaacttcttttatacgggaataaagtttcctacgtgtaggattttgtatgtaccgtatgaataagcatcggctaactccgtgccagcagccgcggtaatacggaggatgcgagcgttatccggatttattgggtttaaagggagcgcagacgggagattaagtcagttgtgaaagtttgcggctcaaccgtaaaattgcagttgatactggtttccttgagtgcagttgaggcaggcggaattcgtggtgtagcggtgaaatgcttagatatcacgaagaaccccgattgcgaaggcagcttgctaaactgtaactgacgttcatgctcgaaagtgtgggtatcaaacaggattagataccctggtagtccacacggtaaacgatggatactcgctgttggcgatatactgtcagcggccaagcgaaagcattaagtatcccacctggggagtacgccggcaacggtgaaactcaaaggaattgacgggggcccgcacaagcggaggaacatgtggtttaattcgatgatacgcgaggaaccttacccgggcttaaattgcagacgaattacgaggaaacttgtaagccgcaaggcgtctgtgaaggtgctgcatggttgtcgtcagctcgtgccgtgaggtgtcggcttaagtgccataacgagcgcaaccctcgtggtcagttactaacaggttaagctgagggctctggccagactgccatcgtaagatgtgaggaaggtggggatgacgtcaaatcagcacggcccttacgtccggggctacacacgtgttacaatgggaggtacagaaggccgctacccggcaacgggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaaccggtaattggggctaagtcgtaacaaggtagccgtaccggaaggtgcggctggaacacctcctttct

SEQ ID NO: 273 - DNA, 1535 bp, Bacteroides coprophilus
ttacaatgaagagtttgatcctggctcaggatgaacgctagctacaggcttaacacatgcaagtcgaggggcagcgggattgaagcttgcttcaattgccggcgaccggcgcacgggtgagtaacgcgtatccaaccttccgcttactcggggatagcctttcgaaagaaagattaatacccgatggtatcttaagcacgcatgagattaagattaaagatttatcggtaagcgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcgagagcctgaaccagccaagtagcgtgaaggatgacggccctacgggttgtaaacttcttttgtgcgggaataaaggaacctacgtgtaggtttttgcatgtaccgtaacgaataagcatcggctaactccgtgccagcagccgcggtaatacggaggatgcgagcgttatccggatttattgggtttaaagggagcgtagacgggtttttaagtcagctgtgaaagtttggggctcaaccttaaaattgcagttgaaactggagaccttgagtacggttgaggcaggcggaattcgtggtgtagcggtgaaatgcttagatatcacgaagaaccccgattgcgaaggcagcctgctaagccgccactgacgttgaggctcgaaagtgcgggtatcaaacaggattagataccctggtagtccgcacggtaaacgatggatactcgctgttggcgatagacagtcagcggccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaactgcagtggaattatccggaaacggataagcgagcaatcgccgctgtggaggtgctgcatggttgtcgtcagctcgtgccgtgaggtgtcggcttaagtgccataacgagcgcaacccttgctgccagttactaacaggtcatgctgaggactctggcaggactgccatcgtaagatgcgaggaaggtggggatgacgtcaaatcagcacggcccttacgtccggggctacacacgtgttacaatggggagtacagagggcagctaccgggcgaccggatgcgaatcccgaaagctcctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtacgtaaccgcgaggatcgtcctagggtaaaaccggtaattggggctaagtcgtaacaaggtagccgtaccggaaggtgcggctggaacacctcctttct

SEQ ID NO: 274 - DNA, 1384 bp, Bacteroides dorei
gaggggcagcatggtcttagcttgctaaggctgatggcgaccggcgcacgggtgagtaacacgtatccaacctgccgtctactcttggccagccttctgaaaggaagattaatccaggatggcatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcga

SEQ ID NO: 275 - DNA, 1382 bp, Bacteroides eggerthii
tcgaggggcagcatgattgaagctgtgcttcaattgatggcgaccggcgcacgggtgagtaacacgtatccaacctgccgataactcggggatagcctttcgaaagaaagattaatacccgatagtatagtatttccgcatggtttcactattaaagaatttcggttatcgatggggatgcgttccattagatagttggcggggtaacggcccaccaagtcaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtggagtatgcatactcctttgtatgtaccgtatgaataaggatcggctaactccgtgccagcagccgcggtaatacggaggatccgagcgttatccggatttattgggtttaaagggagcgtaggcgggtgcttaagtcagttgtgaaagtttgcggctcaaccgtaaaattgcagttgatactgggcgccttgagtgcagcataggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgttggcgatacacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaagttgtgaaggtttgcggctcaaccgtaacatcgcactggatactgggcggcttgagtgtagtatacgtaggcggaagccgtgaggtgtcggcttaagtgccataacgagcgcaacccttatctatagttactatcaggtcatgctgaggactctatggagactgccgtcgtaagatgtgaggaaggtggggatgacgtcaaatcagcacggcccttacgtccggggctacacacgtgttacaatggggggtacagaaggcagctacctggcgacaggatgctaatccctaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaa

SEQ ID NO: 276 - DNA, 1383 bp, Bacteroides faecis
tcgaggggcagcattccagtttgcttgcaaactggagatggcgaccggcgcacgggtgagtaacacgtatccaacctgccgataactcggggatagcctttcgaaagaaagattaatacccgatggcataatagaaccgcatggtttgattattaaagaatttcggttatcgatggggatgcgttccattaggcagttggtggggtaacggcccaccaaaccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgatccacgtgtggatttttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagtcgtaagacgaatgtgactgtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 277 - DNA, 1306 bp, Bacteroides finegoldii
  modified_base (1029)..(1029): a, c, t, g, unknown or other
  modified_base (1125)..(1125): a, c, t, g, unknown or other
  modified_base (1261)..(1261): a, c, t, g, unknown or other
  modified_base (1281)..(1281): a, c, t, g, unknown or other
aagatggcgaccggcgcacgggtgagtaacacgtgtccaacctgccgataactcagggatagcctttcgaaagaaagattaatacctgatggcataggattgtcgcatgataatcctattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgggagtctgaaccagccaagtagcgtgaaggatgactgccctatgggttgtaaacttcttttatacgggaataaagtgatccacgggtttttgtatgtaccgtatgaataaggatcggctaactccgtgccagcagccgcggtaatacggaggatccgagcgttatccggatttttgggtttaaagggagcgtagtggattgttaagtcagttgtgaaagtttgcggctcaaccgtaaaattgcagttgatactggcagtcttgatacagtaaggtgggcggaattcgtggtgtacggtgaaatgcttaatatcacgaaaactccgattgcgaaggcagctcactggactgcaactgacactgatgctcgaaagtgtgggtatcaaacaggattaataccctggtagtccacacagtaaacgatgaatactcgctgtttgcgatatacggtaagcggccaagcgaaagcgttaagtattccacctggggagtacgccggcaacggtgaaactcagaggaattgacgggggcccgcacaagcggaggaacatgtggtttaattgtatgatactcgaggaaccttacccgggcttaaattacctttgaattatctggaaacaggttaaccgtaaggcacagtgaaggttgctgcatggttgtcgtcagctcgtgccgtgaggtgtcggcttaagttccataacgagcgcaacccttatcttcagttactaacaggtcatgntgaggactctggagagactgccgtcgtaagatgtgaggaaggtggggatgacgtcaaatcagcacggcccttacgtccggggctacacacgtgttncaatggggggtacagaaggcagctacctggtgacaggatgctaatcccaaaaacctctctcagttcggatcgaagtctgcaacccgacttcgtgaagctggattcgttagtaatcgcgcatcacccatggcgcggngaatacgttcccgggccttnccaccccgcccctcaagccatgaaa

SEQ ID NO: 278 - DNA, 1529 bp, Bacteroides fluxus
ttacaatgaagagtttgatcctggctcaggatgaacgctagctacaggcttaacacatgcaagtcgaggggcagcatttttatagcaatataaaagatggcgaccggcgcacgggtgagtaacacgtatccaacctgccgataactcggggataacccttcgaaagaaggcctaatacccgatggcatatcccttccgcctggttgggatattaaagaacttcggttatcgatggggatgcgttccattagcttgttggcggggtaacggcccaccaaggcttcgatggataggggttctgagaggaaggtcccccacattggaactgagacacggtccaaactcctacgggaggcagcagtgaggaatattggtcaatggacgagagtctgaaccagccaagtagcgtgaaggatgaaggtcctatggattgtaaacttcttttatacgggaataaagtgcagtatgcatactgttttgtatgtaccgtatgaataaggatcggctaactccgtgccagcagccgcggtaatacggaggatccgagcgttatccggatttattgggtttaaagggagcgtaggcggatgcttaagtcagttgtgaaagtttgcggctcaaccgtaaaattgcagttgatactgggcgtcttgagtacagtagaggcaggcggaattcgtggtgtagcggtgaaatgcttagatatcacgaagaactccgattgcgaaggcagcctgctggactgtcactgacgctgatgctcgaaagtgtgggtatcaaacaggattagataccctggtagtccacacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcatatgagttatccggagacggataagccgcaaggcatatgtgaaggtgctgcatggttgtcgtcagctcgtgccgtgaggtgtcggcttaagtgccataacgagcgcaacccttatcgatagttaccatcaggtcatgctggggactctgtcgagactgccgtcgtaagatgcgaggaaggtggggatgacgtcaaatcagcacggcccttacgtccggggccacacacgtgttacaatggggggtacagaaggccgctacacagcgatgtgatgccaatccccaaaacccctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacctcctttct

SEQ ID NO: 279 - DNA, 1383 bp, Bacteroides fragilis
  modified_base (23)..(23): a, c, t, g, unknown or other
tcgaggggcatcaggaagaaagnttgctttctttgctggcgaccggcgcacgggtgagtaacacgtatccaacctgccctttactcggggatagcctttcgaaagaaagattaatacccgatggcataatgattccgcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggtatgatgtgggaacatgtcagtgagcaatcaccgctgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaa

SEQ ID NO: 280 - DNA, 1431 bp, Bacteroides galacturonicus
  modified_base (786)..(786): a, c, t, g, unknown or other
  modified_base (1402)..(1402): a, c, t, g, unknown or other
tgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcnccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagtccggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaacgtaagaaggagccgccnaaggcaggtctgataactggggtgaagtc

SEQ ID NO: 281 - DNA, 1513 bp, Bacteroides helcogenes
agagtttgatcctggctcaggatgaacgctagctacaggcttaacacatgcaagtcgaggggcagcattgtcatagcaatatgacagatggcgaccggcgcacgggtgagtaacacgtatccaacctgccttccactcgggaatagcctttcgaaagaaagattaatgcccgatggcactgaaagaggtcatcctttttcagttaaagaatttcggtggaagatggggatgcgttccattagcttgttggcggggtaacggcccaccaaggcatcgatggataggggttctgagaggaaggtcccccacattggaactgagacacggtccaaactcctacgggaggcagcagtgaggaatattggtcaatgggcgggagcctgaaccagccaagtagcgtgaaggatgactgccctatgggttgtaaacttcttttataagggaataaaacgggccacgtgtggccttttgcatgtaccttatgaataaggatcggctaactccgtgccagcagccgcggtaatacggaggatccgagcgttatccggatttattgggtttaaagggagcgcagacggggtcttaagtcagttgtgaaagtttgcggctcaaccgtaaaattgcagttgatactggggctcttgagtgcagtataggcaggcggaattcgtggtgtagcggtgaaatgcttagatatcacgaagaactccgattgcgaaggcagcctgctggactgtaactgacgttcatgctcgaaagtgcgggtatcaaacaggattagataccctggtagtccgcacagtaaacgatgaatactcgctgttggcgatacacagtcagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgctaatgaatatggcggaaacgtcatagccgcaaggcattagtgaaggtgctgcatggttgtcgtcagctcgtgccgtgaggtgtcggcttaagtgccataacgagcgcaacccttatctatagttaccatcaggcaatgctggggactctatggagactgccgtcgtaagatgtgaggaaggttgggatgacgtcaaatcagcacggcccttacgtccggggctacacacgtgttacaatggggggtacagaaggcagctacacagcgatgtgatgctaatcccaaaaacctctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaactggtgattggggctaagtcgtaacaaggtagccgtaccggaaggtgcggctggaacacct

SEQ ID NO: 282 - DNA, 1262 bp, Bacteroides heparinolyticus
tcaggatgaacgctagctacaggcttaacacatgcaagtcgagggaccggcgcacgggtgagtaacacgtatccaaccttccggtaactccggtatagcctttcgaaagaaagattaatcccggatagttaaagccggttaccgatggggatgcgttccattaggcagttggcggggtaacggcccaccaaacctacgatggataggggttctgagaggaaggtcccccacattggaactgagacacggtccaaactcctacgggaggcagcagtgaggaatattggtcaatgggcggaagcctgaaccagccaagtagcgtgaaggatgactgcctatgggttgtaaacttcttttataagggaatatgcatgtaccttatgaataaggatcggctaactccgtgccagcagccgcggtaatacggaggatccgagcgttatccggatttattgggtttaaagggagcgtaggcgggcgcttaagtcagctgtgaaagtttggggctcaaccttaaaattgcagttgatactgggtgccttgagtgcagtataggcaggcggaattcgtggtgtagcggtgaaatgcttagatatcacgaagaactcctattgcgaaggcagcttgctggagtgactgacgctgatgctcgaaagtgtgggtatcaaacaggattagataccctggtagtccacacagtaaacgatgaatactcgctgtttgcgtgcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccttatccacagttaccatcagctggggactctgtggagactgccgtcgtaagatggaggaagggggggatgacgtcaaatcagcacggcccttacgtccggggctacacacgtgttacaatggggggcagcaggcagctcggcggcgacgcccggccaatccctcccctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtag

SEQ ID NO: 283 - DNA, 1301 bp, Bacteroides intestinalis
ttattccgggatagcctttcgaaagaaagattaatactggatagcataacgagaaggcatcttcttgttattaaagaatttcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgcagtatgtatactgttttgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacggatttggaaacagatcttccttcgggcagttgtgaattgcgaaggcggtttactgcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaa

SEQ ID NO: 284 - DNA, 1281 bp, Bacteroides massiliensis
catgcaagtcgagggaccggcgcacgggtgagtaacgcgtatccaacctgccttacactcttggacagccttctgaaagggagattaatacaagatgtttaaagccggtgtaagatggggatgcgttccattagatagtaggcggggtaacggcccacctagtcttcgatggataggggttctgagaggaaggtcccccacattggaactgagacacggtccaaactcctacgggaggcagcagtgaggaatattggtcaatggacgagagtctgaaccagccaagtagcgtgaaggatgaaggtttatggattgtaaacttcttttatacgggaatatgcatgtaccgtatgaataaggatcggctaactccgtgccagcagccgcggtaatacggaggatccgagcgttatccggatttattgggtttaaagggagcgtagatgggttgttaagtcagttgtgaaagtttgcggctcaaccgtaaaattgcaattgatactggcagtcttgagtacagttgaggtaggcggaattcgtggtgtagcggtgaaatgcttagatatcacgaagaactccgattgcgaaggcagcttactaacctgactgacattgatgctcgaaagtgtgggtatcaaacaggattagataccctggtagtccacacggtaaacgatgaatactcgctgtaggcgagtctgcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttgccgatagttactaacagctgaggactctgtcgggactgccatcgtaagatggaggaaggtggggatgacgtcaaatcagcacggcccttacgtccggggctacacacgtgttacaatggggggcagagggctgctaccacgcaagtggatgccaatcccacctctctcagttcggatgaagtctgcaacccgacttcagaagctggattcgctagtaatcgcgcatcagccacggcgcggtgaatacgttcccgggccttgtacacaccgcccgtcaagccatgggagccgggggtacctgaagtgcgtagcgccctagggtaaaactggtgactggggctaagtcgtaacaaggtaacc

SEQ ID NO: 285 - DNA, 1377 bp, Bacteroides nordii
  modified_base (12)..(13): a, c, t, g, unknown or other
tcgaggggcagnnggatgtagcaatacattgctggcgaccggcgcacgggtgagtaacacgtatccaacctgccttttactcggggataggctttcgaaagaaagattaatacccgatggtataatatttccgcatgggattattattaaagaatttcggtaaaagatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatgggcgaaagcctgaaccagccaagtagcgtgaaggatgactgccctatgggttgtaaacttcttttataggggaataaaatgagccacgtgtggctttttgtatgtaccctatgaataaggatcggctaactccgtgccagcagccgcggtaatacggaggatccgagcgttatccggatttattgggtttaaagggagcgtaggtggacatgtaagtcagttgtgaaagtttgcggctcaaccgtaaaattgcagttgatactgtgtgtcttgagtacagtagaggtgggcggaattcgtggtgtagcggtgaaatgcttagatatcacgaagaactccgattgcgaaggcagctcactggactgttactgacactgaggctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatgttggggaaacccaacagccgtaaggcaaatgtgagcaggctgcatggtggtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaa

SEQ ID NO: 286 - DNA, 1485 bp, Bacteroides oleiciplenus
agagtttgatcctggctcaggatgaacgctagctacaggcttaacacatgcaagtcgaggggcatcaggatgtagcaatacattgctggcgaccggcgcacgggtgagtaacacgtatccaacctaccgattattccgggatagcctttcgaaagaaagattaatactggatagtataacgagaaggcatctttttgttattaaagaatttcgataatcgatggggatgcgttccattagtttgttggcggggtaacggcccaccaagacttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttatatgggaataaagtgcagtatgtatactgttttgtatgtaccatatgaataaggatcggctaactccgtgccagcagccgcggtaatacggaggatccgagcgttatccggatttattgggtttaaagggagcgtaggcggaagcttaagtcagttgtgaaagtttgcggctcaaccgtaaaattgcagttgatactgggtttcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacgtaggtggaaacatctattccttcgggcagttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacacggcgacgtgatgctaatcccaaaaacctctctcagttcggattggagtctgcaactcgactccatgaagctggattcgctagtaatcgcgcatcagccacggcgcggtgaatacgttcccgggccttgtacacaccgcccgtcaagccatgaaagccgggggtacctgaagtccgtaaccgttaaggagcggcctagggtaaaactggtaattggggctaagtcgtaacaaggtaacc

SEQ ID NO: 287 - DNA, 1381 bp, Bacteroides ovatus
  modified_base (25)..(25): a, c, t, g, unknown or other
tcgaggggcagcattttagtttgcnttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggagccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaattggctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 288 - DNA, 1531 bp, Bacteroides pectinophilus
atgagagtttgatcctggctcaggatgaacgctggcggcgtgcttaacacatgcaagtcgaacgaagcacttaatgagatttcttcggattgattattttgtgactgagtggcggacgggtgagtaacgcgtgggtaacctgccccagaccgggggataacagtcggaaacgactgctaataccgcataagcgcacagtgccgcatggcacagtgtgaaaaactccggtggtctgggatggacccgcgtccgattagttagttggcggggtaacggcccaccaagaccgcgatcggtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctgtcagcagggaagataatgacggtacctgaccaagaagccccggctaactacgtgccagcagccgcggtaatacgtagggggcaagcgttatccggatttactgggtgtaaagggagtgtaggtggctgtgcaagtcaggagtgaaagcccggggctcaaccccgggactgctcttgaaactgcgcagcttgagtgcaggaggggcaggcggaattcctagtgtagcggtgaaatgcgtagatattaggaggaacaccggtggcgaaggcggcctgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggtcttgacatcctcctgaacggaaggtaatgcttccggtccttcgggacaggagagacaggtggtgcatggttgtcgtcagctcgtgtcgtgagatgttgggttaagtcccgcaacgagcgcaacccctatcctcagtagccagcagtccggctgggcactctgtggagactgccggggataacccggaggaaggtggggatgacgtcaaatcatcatgccccttatgacctgggctacacacgtgctacaatggcgctcaacaaagggaagcaatgccgcgaggccgagcaaatcccaaaaacagcgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagtcagtgacccaaccgcaaggagggagctgccgaaggcaggtctggtaactggggtgaagtcgtaacaaggtagccgtatcggaaggtgcggctggatcacctcctttct

SEQ ID NO: 289 - DNA, 1326 bp, Bacteroides plebeius
gagtttgatcctggctcaggatgaacgctagctacaggcttaacacatgcaagtcgagggaccggcgcacgggtgagtaacgcgtatccaaccttccgtacactcagggatagcctttcgaaagaaagattaatacctgatggttaaagtcggtgtacgatggggatgcgttccattaggtagtaggcggggtaacggcccacctagcctacgatggataggggttctgagaggaaggtcccccacattggaactgagacacggtccaaactcctacgggaggcagcagtgaggaatattggtcaatggacgagagtctgaaccagccaagtagcgtgaaggatgaaggtctacggattgtaaacttcttttataagggaatatgtatgtaccttatgaataagcatcggctaactccgtgccagcagccgcggtaatacggaggatgcgagcgttatccggatttattgggtttaaagggagcgcagacgggtcgttaagtcagctgtgaaagtttggggctcaaccttaaaattgcagttgatactggcgtccttgagtgcggttgaggtgtgcggaattcgtggtgtagcggtgaaatgcttagatatcacgaagaactccgattgcgaaggcagcacactaagccgactgacgttcatgctcgaaagtgtgggtatcaaacaggattagataccctggtagtccacacggtaaacgatggatactcgctgttggcgagtcagcggcttagcgaaagcgttaagtatcccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaaccctcgccgccagttactaacagctgaggactctggcgggactgccatcgtaagatggaggaaggtggggatgacgtcaaatcagcacggcccttacgtccggggctacacacgtgttacaatgggcggcagaaggcagctacctggcgacaggatgccaatcccgccgctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtgcgtagcgccctagggtaaaaccggtaattggggctaagtcgtaacaaggtaacc

SEQ ID NO: 290 - DNA, 1458 bp, Bacteroides pyogenes
ttagagtttgatcctggctcaggatgaacgctagctacaggcttaacacatgcaagtcgaggggcagcatgaatattggcttgccaatatttgatggcgaccggcgcacgggtgagtaacacgtatccaaccttccggttactcggggataggctttcgaaagaaagattaatacccgatgttgtgtatctttctcctgattgatacgccaaaggattccggtaaccgatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatggacggaagtctgaaccagccaagtagcgtgaaggatgactgccctctgggttgtaaacttcttttatacgggaataacatgaggtacgggtaccttattgcatgtaccgttatgaataagcatcggctaactccgtgccagcagccgcggtaatacggaggatgcgagcgttatccggatttattgggtttaaagggagcgtaggtgggatattaagtcagctgtgaaagtttggggctcaaccttaaaattgcagttgatactggttttcttgagtacggtataggtgggcggaattcgtggtgtagcggtgaaatgcttagatatcacgaagaactcctattgcgaaggcagctcactggaccggcactgacactgatgctcgaaagtgcgggtatcaaacaggattagataccctggtagtccgcacagtaaacgatgaatactcgctgtttgcgatacacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcgctggcttttaccggaaacggtattttcttcggaccagcgtgaaggtgctgcatggttgtcgtcagctcgtgccgtgaggtgtcggcttaagtgccataacgagcgcaacccttatctttagttgccatcaggttttgctggggactctaaagagactgccgtcgtaagatgcgaggaaggtggggatgacgtcaaatcagcacggcccttacgtccggggctacacacgtgttacaatggggagcacagcaggttgctacacggcgacgtgatgccaatccgtaaaactcctctcagttcggatcgaagtctgcaacccgacttcgtgaagctggattcgctagtaatcgcgcatcagccacggcgcggtgaatacgttcccgggccttgtacacaccgcccgtcaagccatgaaagccgggggtacctgaagtacgtaaccgcaaggatcgtccttagtaaac

SEQ ID NO: 291 - DNA, 1521 bp, Bacteroides salanitronis
agagtttgatcctggctcaggatgaacgctagctacaggcttaacacatgcaagtcgcggggcagcgggagcctagcttgctaggcttgccggcgaccggcgcacgggtgagtaacgcgtatccgaccttccgcacactccgggccagccttccgaaaggaagattaatcccggatggtatggcgtggctgcatggcagcgccattaaaggagcgatccggtgtgcgatgggggtgcgttccattagcttgttggcggggtaacggcccaccaaggcgacgatggataggggttctgagaggaaggccccccacattgggactgagacacggcccaaaactcctacgggaggcagcagtgaggaatattggtcaatgggcgagagcctgaaccagccaagtagcgtggaggatgaccgccctacgggttgtaaactccttttataagggaataaaacctcccacgtgtgggagcttgtatgtaccttatgaataagcatcggctaactccgtgccagcagccgcggtaatacggaggatgcgagcgttatccggatttattgggtttaaagggagcgtagacgggatgtcaagtcagctgtgaaagtttgcggctcaaccgtaaaattgcagttgaaactggctttcttgagtgcgttcgaggcaggcggaattcgtggtgtagcggtgaaatgcatagatatcacgaagaaccccgattgcgaaggcagcctgctaggccgcaactgacgttgatgctcgaaagtgcgggtatcaaacaggattagataccctggtagtccgcacggtaaacgatgggcactcgctgccggcgatatactgccggcggcttagcgaaagcgttaagtgccccacctggggagtacgccggcaacggtgaaactcaaaggaattgacgggggcccgcacaagcggaggaacatgtggtttaattcgatgatacgcgaggaaccttacccgggcttgaactgcggatgcattgcgcggaaacgcgcaagtgggcaaccacatccgtggaggtgctgcatggttgtcgtcagctcgtgccgtgaggtgtcggcttaagtgccataacgagcgcaaccccttccgccagttgccatcaggttatgctggggactctggcggtactgccatcgtaagatgcgaggaaggtggggatgacgtcaaatcagcacggcccttacgtccggggctacacacgtgttacaatggggggtacagagggccgccatccggcgacggagcgccaatccctaaagcccctcccagttcggactggagcctgcaacccggctccacgaagctggattcgctagtaatcgcgcatcagccacggcgcggtgaatacgttcccgggccttgtacacaccgcccgtcaagccatgaaagccgggggtgcctgaagtgcgtaaccgaaaggggcgccctagggtaaaaccggtgattggggctaagtcgtaacaaggtagccgtaccggaaggtgcggctggaacacct

SEQ ID NO: 292 - DNA, 970 bp, Bacteroides salyersiae
  modified_base (946)..(946): a, c, t, g, unknown or other
  modified_base (948)..(948): a, c, t, g, unknown or other
tcgaggggcatcagggtgtagcaatacgccgctggcgaccggcgcacgggtgagtaacacgtatccaacctgccctttactcggggatagcctttcgaaagaaagattaatacccgatggtataacatgacctcctggttttgttattaaagaatttcggtagaggatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatgggcgagagcctgaaccagccaagtagcgtgaaggatgaccgccctatgggttgtaaacttcttttatatgggaataaagtctgccacgtgtggcattttgtatgtaccatatgaataaggatcggctaactccgtgccagcagccgcggtaatacggaggatccgagcgttatccggatttattgggtttaaagggagcgtaggtggacatgtaagtcagttgtgaaagtttgcggctcaaccgtaaaattgcagttgatactgcgtgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaatatgccggnancggcatagccgcaaggcatttg

SEQ ID NO: 293 - DNA, 1533 bp, Bacteroides sp. 1_1_14
ttacaatgaagagtttgatcctggctcaggatgaacgctagctacaggcttaacacatgcaagtcgaggggcagcatttcagtttgcttgcaaactggagatggcgaccggcgcacgggtgagtaacacgtatccaacctgccgataactcggggatagcctttcgaaagaaagattaatacccgatggtataatcagaccgcatggtcttgttattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 294 - DNA, 1345 bp, Bacteroides sp. 1_1_30
tggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggcagctcacgagactgcaactgacgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 295 - DNA, 1381 bp, Bacteroides sp. 1_1_6
  modified_base (1333)..(1333): a, c, t, g, unknown or other
  modified_base (1337)..(1338): a, c, t, g, unknown or other
aggggcagcatttcagtttgcttgcaaactggagatggcgaccggcgcacgggtgagtaacacgtatccaacctgccgataactcggggatagcctttcgaaagaaagattaatacccgatggtataatgaaaccgcatggtcttattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccncggnntcaagccatgaaagccgggggtacctgaagtacgtaaccgcaa

SEQ ID NO: 296 - DNA, 1385 bp, Bacteroides sp. 20_3
  modified_base (7)..(7): a, c, t, g, unknown or other
  modified_base (19)..(24): a, c, t, g, unknown or other
tcgaggnggcagcacaggnnnnnntaccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacacagtaagcggcacagcgaaagcgttaagtgatccacctggggagtacgccggcaacggtgaaactcaaaggaattgacgggggcccgcacaagcggacgaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatc

SEQ ID NO: 297 - DNA, 1382 bp, Bacteroides sp. 2_1_22
tcgaggggcagcattttagtttgcttgcaaactgaagatggcgaccggcgcacgggtgagtaacacgtatccaacctgccgataactccgggatagcctttcgaaagaaagattaataccggatggcatactaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 298 - DNA, 945 bp, Bacteroides sp. 2_1_56FAA
  modified_base (490)..(490): a, c, t, g, unknown or other
  modified_base (760)..(760): a, c, t, g, unknown or other
  modified_base (775)..(775): a, c, t, g, unknown or other
  modified_base (784)..(785): a, c, t, g, unknown or other
  modified_base (848)..(848): a, c, t, g, unknown or other
  modified_base (867)..(867): a, c, t, g, unknown or other
  modified_base (887)..(888): a, c, t, g, unknown or other
  modified_base (902)..(902): a, c, t, g, unknown or other
  modified_base (909)..(909): a, c, t, g, unknown or other
  modified_base (919)..(919): a, c, t, g, unknown or other
  modified_base (934)..(935): a, c, t, g, unknown or other
ttgctggcgaccggcgcacgggtgagtaacacgtatccaacctgccctttactcggggatagcctttcgaaagaaagattaatacccgatagcataatgattccgcatggtttcattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgttagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtangtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggncaagcgaaagcattnaagtattcnncctggggagtacgccggcaacggtgaaactcaaaggaattgacgggggcccgcacaagcggangaacatgtggtttaattcnatgatacgcgaggaaccttnncccgggcttaaatngcagtgnaatgatgtgnaaacatgtcagtganncatcaccact

SEQ ID NO: 299 - DNA, 1525 bp, Bacteroides sp. 2_2_4
tacaatgaagagtttgatcctggctcaggatgaacgctagctacaggcttaacacatgcaagtcgaggggcagcatttcgctagcaatagtgaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactgggagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 300 - DNA, 1362 bp, Bacteroides sp. 315-5
taggcttaacacatgcaagtcgaggggcagcattatcttagcttgctaagatagatggcgaccggcgcacgggtgagtaacacgtatccaaccttccggttactcggggataggctttcgaaagaaagattaatacccgatgttgcgtatctttctcctgaaagatacgccaaaggattccggtaaccgatggggatgcgttccattaggcagttggcggggtaacggcccaccaaaccttcgatggataggggttctgagaggaaggtcccccacattggaactgagacacggtccaaactcctacgggaggcagcagtgaggaatattggtcaatggacggaagtctgaaccagccaagtagcgtgaaggatgactgccctctgggttgtaaacttcttttatacgggaataacatgaggtacgcgtaccttattgcatgtaccgttatgaataagcatcggctaactccgtgccagcagccgcggtaatacggaggatgcgagcgttatccggatttattgggtttaaagggagcgtaggtgggatattaagtcagctgtgaaagtttggggctcaaccttaaaattgcagttgatactggtttccttgagtacggtacaggtgggcggaattcgtggtgtagcggtgaaatgcttagatatcacgaagaactccgatcgcgaaggcagctcaccgggccggaactgacactgatgctcgaaagtgcgggtatcaaacaggattagataccctggtagtccgcacagtaaacgatgaatactcgctgtttgcgatacacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcgctggcttttaccggaaacggtattttcttcggaccagcgtgaaggtgctgcatggttgtcgtcagctcgtgccgtgaggtgtcggcttaagtgccataacgagcgcaacccttatctttagttactaacagttttgctgaggactctaaagagactgccgtcgtaagatgcgaggaaggtggggatgacgtcaaatcagcacggcccttacgtccggggctacacacgtgttacaatggggagcacagcaggttgctacacggcgacgtgatgccaatccgtaaaactcctctcagttcggatcgaagtctgcaacccgacttcgtgaagctggattcgctagtaatcgcgcatcagccacggcgcggtgaatacgttcccgggccttgtacacaccgcccgtcaag

SEQ ID NO: 301 - DNA, 1243 bp, Bacteroides sp. 31SF15
taacacatgcacgtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaacgagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttacttacagctgaggactctagagagactgccgtcgtatgatggaggaaggtggggatgacgtcaaatcagcacggtcctatcgtccggggatacacacgtgttacaatggggggcagaaggcagctacacagcgatgtgatgctaatcccacctctagcagttcggatggagtctgcaacccgactccagaagctggattcgctagtaatcgcgcatcagcacggcgcggtgaatacgttcccgggccttgtacacaccgcccgtcaagccatgaaagccgggggtacctgaagtccgacggcctagg

SEQ ID NO: 302 - DNA, 1207 bp, Bacteroides sp. 31SF18
acacatgcaagtcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattactggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccat

SEQ ID NO: 303 - DNA, 1254 bp, Bacteroides sp. 35AE31
caggcttaacacatgcaagtcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccaggcgcggtgaatacgttcccgggccttgtacacaccgcccgtcaagccatgaaagccgggggtacctgaagtccgtagcggcctagggta

SEQ ID NO: 304 - DNA, 1238 bp, Bacteroides sp. 35AE37
gcttaacacatgcaagtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgacccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgagccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccatgaaagccgggggtacctgaagtccga

SEQ ID NO: 305 - DNA, 1229 bp, Bacteroides sp. 35BE34
tcgagggaccggcgcacgggtgagtaacacgtatccaacctaccggttattctgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacaggattagataccctggtagtccacacagtaaacgatgaatactcgctgtttgcgagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgcctaaacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacacagcgatgtgatgctaatcccacctctctcagttcggatggagtctgcaacccgactccagaagctggattcgctagtaatcgtgcatcagccacggcgcggtgaatacgttcccgggccttgtacacaccgcccgtcaagccatgaaagccgggggtacctgaagtccgacggccta

SEQ ID NO: 306 - DNA, 1250 bp, Bacteroides sp. 35BE35
acacatgcaagtcgagggaccggcgcacgggtgagtaacacgtatccaacctaccggttattccgggatagcctttcgaaagaaagattaataccggatagttaaagtcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgcctatgggttgtaaacttcttttatatgggaatatgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgactgacgctgatgctcgaaagtgtgggtatcaaacatgattagataccctggtagtccacacagtaaacgatgaatactcgctgtttgcgagcaagcggccaagcgaaagcattaagtattccacctggggagtacgccggcactggcgaaactcaaaggaattgacgggggcccgcacaagcggaggaacatgtggtttaattcgatgatacgcgaggaaccttacccgggcttaaattgtgaaggtgctgcatggttgtcgtcagctcgtgccgtgaggtgtcggcttaagtgccataacgagcgcaacccttatctttagttactaacagctgaggactctagagagactgccgtcgtaagatggaggaaggtggggatgacgtcaaatcagcacggcccttacgtccggggctacacacgtgttacaatggggggcagaaggcagctacatagcgatgtgatgctaatcccacctctctcagttcggatggagtctgcaacccgactccagaagctggattcgctagtaatcgcgcatcagccacggcgcggtgaatacgttcccgggccttgtacacaccgcccgtcaagccaataaagccgggggtacttgaagtccgagcggcctagggtaaaac

SEQ ID NO: 307 - DNA, 1351 bp, Bacteroides sp. 3_1_19
  modified_base (301)..(301): a, c, t, g, unknown or other
taccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgtaagnctgaaccagccaagtcgcgtgagggatgaaggttctatggatcgtaaacctcttttataagggaataaagtgcgggacgtgtcccgttttgtatgtaccttatgaataaggcggctaactccgtgccagcagccgcggtaatacggaggccagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaa

SEQ ID NO: 308 - DNA, 1362 bp, Bacteroides sp. 3_1_23
gtcgaggggcagcattttagtttgcttgcaaactgaagatggcgaccggcgcacgggtgagtaacacgtatccaacctgccgataactccggaatagcctttcgaaagaaagattaataccggatggtatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggggcctgaacagccaagtacgtgaaggcttgggaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtgaagctgttgtgaatgtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 309 - DNA, 1532 bp, Bacteroides sp. 3_1_33FAA
tacaatgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctt

SEQ ID NO: 310 - DNA, 1045 bp, Bacteroides sp. 3_1_40A
  modified_base (23)..(23): a, c, t, g, unknown or other
  modified_base (31)..(31): a, c, t, g, unknown or other
  modified_base (33)..(33): a, c, t, g, unknown or other
  modified_base (41)..(41): a, c, t, g, unknown or other
  modified_base (730)..(730): a, c, t, g, unknown or other
caagtagcgtgaaggatgactgncctatggntntaaacttntttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttntgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggag

SEQ ID NO: 311 - DNA, 1367 bp, Bacteroides sp. 3_2_5
  modified_base (1270)..(1270): a, c, t, g, unknown or other
  modified_base (1355)..(1355): a, c, t, g, unknown or other
tcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgacacacggaccaaactcctacgggaggcagcagtgaggaatattggtcaatgggcgaaaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtagcggccttttaagtcacggtgaaagtctgtggctcaccataaattgccgttgaaactggggggcttgagtatgtttgaggcagcggaatgcgtggtgtacggtgaaatgcatagatatcacgcagaaccccgattggaaggcagcctgccaagccattactgacgtgatgcacgaaagcgtggggatcaaacaggattagataccctggtagtccacgcataaacgatgatcactatgtttgcgatacactgtaagcggcacagcgaaagcgttaagtgatccacctggggagtacgccggcaacggtgaaactcaaggaattgacgggggcccgcacaagcggagaacatgtggtttaattgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgngcatcagccatggcgcggtgaatacgttcccgggccttgtacacaccgcccgtcaagccatgggagccgggggtacctgaagtcngtaaccgaaagg

SEQ ID NO: 312 - DNA, 1386 bp, Bacteroides sp. 4_1_36
tcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacttgtcagccgcaaggcagttgtgaagatatcacgaggtactgcgattgcgaagccagctggctgggctttaagtgacactaatggcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagc

SEQ ID NO: 313 - DNA, 1515 bp, Bacteroides sp. 4_3_47FAA
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttataaaggaataaagtcgggtatgtatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttcgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacct

SEQ ID NO: 314 - DNA, 1533 bp, Bacteroides sp. 9_1_42FAA
tacaatgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatgggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctt

SEQ ID NO: 315 - DNA, 1489 bp, Bacteroides sp. AR20
gagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgcgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgt

SEQ ID NO: 316 - DNA, 1502 bp, Bacteroides sp. AR29
  modified_base (11)..(12): a, c, t, g, unknown or other
  modified_base (57)..(57): a, c, t, g, unknown or other
  modified_base (1000)..(1000): a, c, t, g, unknown or other
  modified_base (1008)..(1009): a, c, t, g, unknown or other
  modified_base (1023)..(1023): a, c, t, g, unknown or other
  modified_base (1026)..(1027): a, c, t, g, unknown or other
  modified_base (1033)..(1033): a, c, t, g, unknown or other
  modified_base (1038)..(1038): a, c, t, g, unknown or other
  modified_base (1045)..(1045): a, c, t, g, unknown or other
  modified_base (1057)..(1057): a, c, t, g, unknown or other
  modified_base (1060)..(1060): a, c, t, g, unknown or other
  modified_base (1068)..(1068): a, c, t, g, unknown or other
  modified_base (1091)..(1092): a, c, t, g, unknown or other
  modified_base (1097)..(1097): a, c, t, g, unknown or other
  modified_base (1125)..(1125): a, c, t, g, unknown or other
  modified_base (1127)..(1127): a, c, t, g, unknown or other
  modified_base (1135)..(1135): a, c, t, g, unknown or other
  modified_base (1137)..(1137): a, c, t, g, unknown or other
  modified_base (1144)..(1144): a, c, t, g, unknown or other
  modified_base (1155)..(1156): a, c, t, g, unknown or other
  modified_base (1306)..(1306): a, c, t, g, unknown or other
  modified_base (1350)..(1350): a, c, t, g, unknown or other
  modified_base (1435)..(1435): a, c, t, g, unknown or other
  modified_base (1480)..(1480): a, c, t, g, unknown or other
aataaagtttnnacgtgtggaattttgtatgtaccatatgaataaggatcggctaantccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatattttggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaagaaggcggctntctggacnntaactgacgctgangcnngaaagngtggngagcaancaggattagatnccntggtagtncacgccgtaaacgatgagtagtnngtgtnggggggttacccccctcggtgccgcaantnaagcattnantactccncctgggaaatnngctcgcaagagtgaaaatcaaaagaattgacggggagccccacaagtagcggagcatgtggtttaatttgaagcaacgcggaaaaccttacctaagtttgacattccattgacctttccataatcgaaaatttcccttcggggacagtgntaacaggtggggcatggtttttgtcagctcgtctcgtgaaatgnggggttaattcccccaacgcgcccacccctttcctttttttcccaccattaagttgggcactctagagagactgccgaggataantcggaggaaggtggggatgacgtcaaatcatcatgccccttatgnccagggctacacacgtgctaca

SEQ ID NO: 317 - DNA, 715 bp, Bacteroides sp. B2
  modified_base (650)..(650): a, c, t, g, unknown or other
taggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggangaacatgtggtttaattcgatgatacgcgaggaaccttacccgggcttaaattgcatttgaatat

SEQ ID NO: 318 - DNA, 1517 bp, Bacteroides sp. D1
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacct

SEQ ID NO: 319 - DNA, 1380 bp, Bacteroides sp. D20
  modified_base (8)..(9): a, c, t, g, unknown or other
  modified_base (12)..(12): a, c, t, g, unknown or other
ggggcagnntgnactgtagcttgctaagtttgatggcgaccggcgcacgggtgagtaacacgtatccaacctgccgatgactcggggatagcctttcgaaagaaagattaatacccgatggcataattcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaagg

SEQ ID NO: 320 - DNA, 1533 bp, Bacteroides sp. D22
ttacaatgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaataatctggaaacaggttagccgcaaggcatttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctttct

SEQ ID NO: 321 - DNA, 1040 bp, Bacteroides sp. D2
  modified_base (15)..(15): a, c, t, g, unknown or other
  modified_base (17)..(19): a, c, t, g, unknown or other
  modified_base (33)..(33): a, c, t, g, unknown or other
  modified_base (35)..(36): a, c, t, g, unknown or other
  modified_base (42)..(42): a, c, t, g, unknown or other
gcgtgaaggatgaangnnntatgggtcgtaaantnnttttanatgggaataaagttttccacgtgtggaatttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgcaaggcagttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacccggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggag

SEQ ID NO: 322 - DNA, 1048 bp, Bacteroides sp. F-4
  modified_base (33)..(33): a, c, t, g, unknown or other
  modified_base (42)..(42): a, c, t, g, unknown or other
caagtagcgtgaaggatgactgccctatgggtngtaaacttnttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagc

SEQ ID NO: 323 - DNA, 627 bp, Bacteroides sp. NB-8
  modified_base (407)..(407): a, c, t, g, unknown or other
  modified_base (490)..(490): a, c, t, g, unknown or other
  modified_base (512)..(512): a, c, t, g, unknown or other
  modified_base (515)..(515): a, c, t, g, unknown or other
gaactgagacacggtccaaactcctacgggaggcagcagtgaggaatattggtcaatggacgagagtctgaaccagccaagtagcgtgaaggatgaaggttctatggattgtaaacttcttttatacgggaataaacggatccacgtgtggatttttgcatgtaccgtatgaataaggatcggctaactccgtgccagcagccgcggtaatacggaggatccgagcgttatccggatttattgggtttaaagggagcgtagatgggttgttaagtcagttgtgaaagtttgcggctcaaccgtaaaattgcaattgatactggcagtcttgagtacagttgaggtaggcggaattcgtggtgtagcggtgaaatgcttagatatcacgaagaactccgattgcgaangcagcttactaacctgtaactgacattgatgctcgaaagtgtgggtatcaaacaggattagataccctggtagtccacacggnaaacgatgaatactcgctgtangcnatatacagtctgcggccaagcgaaagcattaagtattccacctggggagtacgcccggcacggtgaaactcaaaggaattgacgggggcccgcacaagcggaggaacatgtg

SEQ ID NO: 324 - DNA, 1361 bp, Bacteroides sp. WH2
agtcgaggggcagcatgacctagcaatagggttgatggggcgaccggcgcacggtgtgagtaacacgtatccaacctaccggttattccgggatagcctttcgaaagaaagattaataccggatagtataacgagaaggcatcttcttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacggcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatatgaatattgtggaaacagaatagccgcaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccggggg

SEQ ID NO: 325 - DNA, 1357 bp, Bacteroides sp. XB12B
cgaggggcagcatgacctagcaataggttgatggcgaccggcgcacgggtgagtaacacgtatccaacctaccggttattccgggatagcctttcgaaagaaagattaataccggatagtataacgagaaggcatctttttgttattaaagaatttcgataaccgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgagccacgtgtggctttttgtatgtaccatacgaataaggatcggctaactccgtgccagcagccgcggtaatacggaggatccgagcgttatccggatttattgggtttaaagggagcgtaggcggactattaagtcagctgtgaaagtttgcggctcaaccgtaaaattgcagttgatactggtcgtcttgagtgcagtagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatctgaataatttggaaacagattagccgcaaggcagatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtac

SEQ ID NO: 326 - DNA, 1407 bp, Bacteroides sp. XB44A
  modified_base (42)..(42): a, c, t, g, unknown or other
gctcaggcttagccatgcaagtcgaggggcagcatgacttancaataggttgatggcgaccggcgcacgggtgagtaacacgtatccaacctgccgattattccgggatagcctttcgaaagaaagattaatactggatagcataacgagaaggcatcttcttgttattaaagaatttcgataatcgatggggatgcgttccattagtttgttggcggggtaacggcccaccaagacatcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttgtatgggaataaagtgagccacgtgtggctttttgtatgtaccatacgaataaggatcggctaactccgtgccagcagccgcggtaatacggaggatccgagcgttatccggatttattgggtttaaagggagcgtaggcggattattaagtcagttgtgaaagtttgcggctcaaccgtaaaattgcagttgatactggtagtcttgagtgcagcagaggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgtttgcgatatacagcaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaactgacggatttggaaacagatcttccttcgggcagttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacacagcgatgtgatgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacttgaagtacgtaaccgcaaggagcgtct

SEQ ID NO: 327 - DNA, 1261 bp, Bacteroides stercoris
atggtatagttttcccgcatgggataattattaaagaatttcggttgtcgatggggatgcgttccattaggcagttggcggggtaacggcccaccaaacctacgatggataggggttctgagaggaaggtcccccacattggaactgagacacggtccaaactcatacgggaggcagcagtgaggaatattggtcaatggacgagagtctgaaccagccaagtagcgtgaaggatgactgccctatgggttgtaaacttcttttatacgggaataaagttagccacgtgtggttttttgtatgtaccgtatgaataaggatcggctaactccgtgccagcagccgcggtaatacggaggatccgagcgttatccggatttattgggtttaaagggagcgtaggcgggttgttaagtcagttgtgaaagtttgcggctcaaccgtaaaattgcagttgatactggcgaccttgagtgcaacagaggtaggcggaattcgtggtgtagcggtgaaatgcttagatatcacgaagaactccgattgcgaaggcagcttactggattgtaactgacgctgatgctcgaaagtgtgggtatcaaacaggattagataccctggtagtccacacagtaaacgatgaatactcgctgttggcgatatacggtcagcggccaagcgaaagcattaagtattccacctggggagtacgccggcagcggtgaaactcaaaggaattgacgggggcccgcacaagcggaggaacatgtggtttaattcgatgatacgcgaggaaccttacccgggcttaaattgcaactgacggaatcggaaacggttctttcttcggacagttgtgaaggtgctgcatggttgtcgtcagctcgtgccgtgaggtgtcggcttaagtgccataacgagcgcaacccttacgggtagttaccatcaggttatgctggggactctacccggactgccgtcgtaagatgtgaggaaggtggggatgacgtcaaatcagcacggcccttacgtccggggctacacacgtgttacaatggggggtacagaaggcagctacacggcgacgtggtgctaatcccaaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcga

SEQ ID NO: 328 - DNA, 962 bp, Bacteroides thetaiotaomicron
  modified_base (754)..(755): a, c, t, g, unknown or other
  modified_base (946)..(948): a, c, t, g, unknown or other
  modified_base (951)..(951): a, c, t, g, unknown or other
tcgaggggcagcatttcagtttgcttgcaaactggagatggcgaccggcgcacgggtgagtaacacgtatccaacctgccgataactcggggatagcctttcgaaagaaagattaatacccgatggtataatgaaaccgcatggtcttattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtnncgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatnnntgnaacagtatagc

SEQ ID NO: 329 - DNA, 1382 bp, Bacteroides uniformis
cgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggtttgaattgcaactgaatgatgtgagtacagtagagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaagg

SEQ ID NO: 330 - DNA, 1370 bp, Bacteroides ureolyticus
gaggaacaacagttggaaacggctgctaatacctcatactcctatttgacataagttaaatagggaaagtcttttcggtgtaggatgagactatatcgtatcagctagttggtaaggtaatggcttaccaaggctatgacgcgtaactggtctgagaggatgatcagtcacattggaactgagacacggtccaaactcctacgggaggcagcagtaaggaatattgcgcaatgggggaaaccctgacgcagcaacgccgcgtggaggatgacacttttcggagcgtaaactccttttatcaggaaagaataatgacggtacctgatgaataagcaccggctaactccgtgccagcagccgcggtaatacggggggtgcaagcgttactcggaatcactgggcgtaaaggacgcgtaggcggattatcaagtcttttgtgaaatctagtggcttaaccactaaactgcttaggaaactgatagtctagagtaggggagaggtagatggaattcttggtgtaggggtaaaatccgtagagatcaagaagaatacccattgcgaaagcgatctgctggaacctaactgacgctgaggcgtgaaagcgtgggtagcaaacaggattagataccctggtagtccacgccctaaacgatgtatactagttgttgctttgctagtcaaggcagtaatgcagctaacgcattaagtataccgcctggggagtacggtcgcaagattaaaactcaaaggaatagacggggacccgcacaagcggtggagcatgtggtttaattcgaagatacgcgaagaaccttacctggacttgacatcctaaaaacatctaagagattagaaagtgctagtttactagaatttagtgacaggtgctgcacggctgtcgtcagctcgtgtcgtgagatgttgggttaagtcccgcaacgagcgcaacccacgtgtttagttgctaacagctcggctgagcactctaaacagactgccttcgtaaggaggaggaaggtgtggacgacgtcaagtcatcatggcccttatgtccagggcgacacacgtgctacaatgacatatacagtaagacgcaatatcgcaagatggagcaaatctataaaatatgtcccagttcggattgtggtctgcaactcgaccccatgaagccggaatcgctagtaatcgtagatcagccatgctacggtgaatacgttcccgggtcttgtactcaccgcccgtcacaccatggaagttgatctcactcgaagcagggatgctaaaatagctaccttccacagtggaatcagtaactggggtgaagtcgtaacaaggtaaccgtaggagaacctgcggttggatcacctcct

SEQ ID NO: 331 - DNA, 1388 bp, Bacteroides vulgatus
  modified_base (36)..(37): a, c, t, g, unknown or other
  modified_base (1072)..(1072): a, c, t, g, unknown or other
agtcgaggggcagcatggtcttagcttgctaagacnngatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgcatacccgtttgcatgtactttatgaataaggatggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacgcaagcggccaagcgaaagcgttaagtattccacctggggagtacgccggcaacggtgaaactcaaaggaattgacgggggcccgcacaagcggaggaacatgtggtttaattcgatgattcgcgaggaaccttacccggtattaaattgcagatgaattacggtaaaagccgtaggccgcaaggcatctgtgaattgatactgggtatcttgacagctcgtgccgtgaggtgtcggcttaagtgccataacgagcgcaacccttgttgtcagttactaacaggttntgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagc

SEQ ID NO: 332 - DNA, 1508 bp, Bacteroides xylanisolvens
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaccgcatggttttactattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtattccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctg

SEQ ID NO: 333 - DNA, 1481 bp, Bacteroidetes bacterium oral taxon D27
agagtttgatcctggctcaggatgaacgctagcggcaggcctaacacatgcaagtcgaggggtagtcccgatttatcgggatgagaccggcgcacgggtgcgtaacgcgtatgcaatctaccttatactaagggatagcccagagaaatttggattaataccttatagttaataaaaaaggcatctttttaattataaagattaattggtataagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatgggcgcaagcctgaaccagccatgccgcgtgcaggatgacgcatctatggtgtgtaaactgcttttgtacaggaagaaacctcccgacgagtcgggacttgacggtactgtaagaataaggatcggctaactccgtgccagcagccgcggtaatacggaggatccaagcgttatccggaatcattgggcttaaagggtccgtaggcggcttaataagtcagcggtgaaagtttttggcttaaccaaaaaattgccattgatactgttaggcttgaatttttgtgaagtaactagaatatgtagtgtagcggtgaaatgcttagatattacatggaataccaattgcgaaggcaggttactaacaaacgattgacgctgatggacgaaagcgtgggtagcgaacaggattagataccctggtagtccacgccgtaaacgatggatactagctgttcgggcgtaagcttgagtggctaagcgaaagtgataagtatcccacctggggagtacgggcgcaagcctgaaactcaaaggaattgacgggagcccgcacaagcggtggagcatgtggtttaattcgatgatacgcgaggaaccttaccagggcttaaatgtattttgaccgtttaggaaactagactttcgcaagacaaaatacaaggtgctgcatggttgtcgtcagctcgtgccgtgaggtgtcaggttaagtcctataacgagcgcaacccctgttgttagttgccagcgagtcaagtcgggaactctaacaagactgccagtgtaaactgtgaggaaggtggggatgacgtcaaatcatcacggcccttacgtcctgggccacacacgtgctacaatggacggcacagagagcagctaccaggtgactggatgcgaatctataaaaccgttctcagttcggatcggagtctgcaactcgactccgtgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactggtaactagggctaagtcgtaacaaggtagccgt

SEQ ID NO: 334 - DNA, 1481 bp, Bacteroidetes bacterium oral taxon F31
agagtttgatcctggctcaggatgaacgctagcggcaggcctaacacatgcaagtcgaggggtagaggaagcttgcttccttgagaccggcgcacgggtgcgtaacgcgtatgcaatctaccttgtacagggggatagcccagagaaatttggattaatacctcatagtgtttaagagtggcatcacttttttactaaagttccaacggtacaagatgagcatgcgtcccattagctagttggtgtggtaacggcataccaaggcaatgatgggtaggggtcctgagagggaggtcccccacactggtactgagacacggaccagactcctacgggaggcagcagtgaggaatattgggcaatggaggcaactctgacccagccatgccgcgtgcaggaagacggtcctatggattgtaaactgcttttgtacgagaagaaacatcccgacgtgtcgggacttgacggtatcgtaagaataaggatcggctaactccgtgccagcagccgcggtaatacggaggatccaagcgttatccggaatcattgggtttaaagggtccgtaggcggtcttataagtcagtggtgaaatctcctagctcaactaggaaactgccattgatactgtaagacttgaatgtttgtgaagtaactagaatatgtagtgtagcggtgaaatgcttagatattacatggaataccaattgcgaaggcaggttactaacagatgattgacgctgatggacgaaagcgtggggagcgaacaggattagataccctggtagtccacgccgtaaacgatggatactagctgttcgagagcaatcttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccagggcttaaatgggagacgacagtttaggaaactagactttcttcggacgtctttcaaggtgctgcatggttgtcgtcagctcgtgccgtgaggtgtcaggttaagtcctataacgagcgcaacccctgttgttagttgccagcgagtaatgtcgggaactctagcaagactgccggtgtaaaccgtgaggaaggtggggatgacgtcaaatcatcacggcccttacgtcctgggccacacacgtgctacaatggcaggtacagagagcagccacttagcgataaggagcgaatctataaaacctgtctcagttcggattggagtctgcaactcgactctatgaagctggaatcgctagtaatcggatatcagccatgatccggtgaatacgttcccgggccttgtacacaccgcccgtcaagccatggaagctgggggtacctgaagtcggtgaccgtaaggagctgcctagggtaaaactagtaactggggctaagtcgtaacaaggtagccgt

SEQ ID NO: 335 - DNA, 1477 bp, Bacteroidetes bacterium oral taxon F44
aagtttgatcctggctcaggatgaacgctagcggcaggcctaacacatgcaagtcgaggggtagaagctttcgggctttgagaccggcgcacgggtgcgtaacgcgtatgcaatctgccttgtactgagggatagcccagagaaatttggattaatacctcatggtattttttgttggcatcaacagattattaaagagattcggtacaagatgagcatgcgtcccattagctagttggtatggtaacggcataccaaggctacgatgggtaggggtcctgagagggagatcccccacactggtactgagacacggaccagactcctacgggaggcagcagtgaggaatattggtcaatggtcgcaagactgaaccagccatgccgcgtgtaggatgaagcatctatggtgtgtaaactacttttgtacgggaagaaacactccctcgtgagggagcttgacggtaccgtaagaataaggatcggctaactccgtgccagcagccgcggtaatacggaggatccaagcgttatccggaatcattgggtttaaagggtccgtaggcggttttataagtcagtggtgaaatccggcagctcaactgtcgaactgccattgatactgtagaacttgaatcattgtgaagtaactagaatatgtagtgtagcggtgaaatgcttagatattacatggaataccaattgcgaaggcaggttactaacaatgtattgacgctgatggacgaaagcgtgggtagcgaacaggattagataccctggtagtccacgccgtaaacgatggatactagctgttcggttgtaagattgagtggctaagcgaaagtgataagtatcccacctggggagtacgggcgcaagcctgaaactcaaaggaattgacgggggcccgcacaagcggtggagcatgtggtttaattcgatgatacgcgaggaaccttaccagggcttaaatgtagtatgacaggtttggaaacagacttttcttcggacatattacaaggtgctgcatggttgtcgtcagctcgtgccgtgaggtgtcaggttaagtcctataacgagcgcaacccctgttgttagttgccatcgagtaatgtcgggaactctaacaagactgccggtgcaaaccgtgaggaaggtggggatgacgtcaaatcatcacggcccttacgtcctgggctacacacgtgctacaatggcaggtacagagagcagccacttcgcaaggaggagcgaatctataaagcctgtctcagttcggattggagtctgcaacccgactccatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactggtaactggggctaagtcgtaacaaggtagccgt

SEQ ID NO: 336 - DNA, 1316 bp, Barnesiella intestinihominis
gatgaacgctagcgacaggcctaacacatgcaagtcgagggaccggcgcacgggtgagtaacacgtatgcaatccacctgtaacagggggataacccggagaaatccggactaataccccataattaaagttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggcctacgggttgtaaacctcttttgtcggagagtatgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgacagacgctgaggcacgaaagcgtgggtatcgaacaggattagataccctggtagtccacgcagtaaacgatgaatactaactgtttgcgtgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcgaggtgctgcatggttgtcgtcagctcgtgccgtgaggtgtcggcttaagtgccataacgagcgcaacccctatcgacagttactaacggccgaggactctgtcgagactgccggcgcaagccggaggaaggtggggatgacgtcaaatcagcacggcccttacgtccggggcgacacacgtgttacaatggcaggcagaaggcagccagtcagcaatgacgcgcgaatcccgcctgtctcagttcggatggagtctgcaacccgactccagaagctggattcgctagtaatcgcgcatcagccatggcgcggtgaatacgttcccgggccttgtacacaccgcccgtcaagccatggaagccgggagtacctgaagcatgcagcgtacgaaggtaataccggtaactggggctaagtcgtaacaaggtagccgtaccggaagg

SEQ ID NO: 337 - DNA, 1461 bp, Barnesiella viscericola
tcaggatgaacgctagcgacaggcctaacacatgcaagtcgaggggcagcgcggaggtagcaatacttctggcggcgaccggcgcacgggtgagtaacacgtatgcaatctgcctgtaacagggggataacccggagaaatccggcctaataccccataacgacatatcttcgcatggggagatgtctaaagagagcaatcttggttacagatgagcatgcggtccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgaaggaagacggccctacgggttgtaaacttcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatgcccgggcttaacccgggagctgccgttgaaactgcgagctagcgtgcacaagaggcaggcggaatgcgtggtgtagcggtgaaatgcatagatatcacgcagaaccccgattgcgaaggcagcctgctagggtgcaacggacgctgaggcacgaaagcgtggggatcgaacaggattagataccctggtagtccacgcagtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatgggtgaaagtccatagccagcaatggtcgcctgcgaggtgctgcatggttgtcgtcagctcgtgccgtgaggtgtcggcttaagtgccataacgagcgcaaccctattgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaactcgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaactggggctaagtc

SEQ ID NO: 338 - DNA, 1492 bp, Bartonella bacilliformis
ttcaacttgagagtttgatcctggctcagaacgaacgctggcggcaggcttaacacatgcaagtcgagcgcactctttttgagtgagcggcagacgggtgagtaacgcgtgggaatctacccatctctacggaataacacagagaaatttgtgctaataccgtatacgtccttcgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccttggaactgcctttgatactggatgtctcgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacactttccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaaccgcaaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaagcaggcaaccacggtagggtcagcgactggggtgaagtcgtaacaaggtagccgtaggggaacctgcggctggatcacctcctttct

SEQ ID NO: 339 - DNA, 1491 bp, Bartonella grahamii
tgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtcctttttggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagga

SEQ ID NO: 340 - DNA, 1492 bp, Bartonella henselae
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcatttggttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaagggggcaggcaaccacggtagggtcagcgactggggtgaagtcgtaacaaggtagccgtaggggaacctgtggctggatcacctcctttct

SEQ ID NO: 341 - DNA, 1493 bp, Bartonella quintana
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccctctgggagaaagatttatcggaggtggatgagcccgcgttggattagctagttggtgaggtaagggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacgttaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtctcgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactactcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggtgacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttct

SEQ ID NO: 342 - DNA, 1228 bp, Bartonella tamiae
tttcggagtgagcggcagacgggtgagtaacacgtgggaatctacccatctctacggaataacacagagaaatttgtgctaataccgtatacgtccttatggagaaagatttatcggagatggatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacatttaagtcagaggtgaaatcccagggctcaaccctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggacagtttactgttcggtggcgcagctaacgcattaaacattccgcctggggagtacggtcgcaagattaaaactcaaaggaattgacgggggcccgcccaagcggtggagcatgtggtttaattcgaagcaacgcgcagaaccttaccagcccttgacatcccgatcgcggttagtggagacactttccttcagttaggctggatcggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtggaatcgctagtaatcgtgg

SEQ ID NO: 343 - DNA, 1324 bp, Bartonella washoensis
gcaagtcgagcgcactcttttagagtgagcggcaaacgggtgagtaacgcgtgggaatctacccctctctacggaataacacagagaaatttgtgctaataccgtatacgtcccttttgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggacatttaagtcagaggtgaaatcccagggctcaaccctggaactgcctttgatactgggtgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccg

SEQ ID NO: 344 - DNA, 1407 bp, Bdellovibrio sp. MPA
catgcaagtcgaacggggaaagctttcgggtgagtactagtggcgcacgggtgagtaacgcgtggataatctgcctttgagtgggggataactagtcgaaagattagctaataccgcataagaccacaggaactgaggttctaggggttaaaggtttttcgctcatagatgagtccgcgtgagattagctagttggtgaggtaacggctcaccaaggcgacgatctctaactggtctgagaggatgatcagtcacactggaactgagacacggtccagactcctacgggaggcagcagtagggaatattgcacaatggaggaaactctgatgcagcgacgccgcgtgagtgatgaaggctttcgggtcgtaaagctctgtcgcaggggaataacacaatgaatgtaccctgtaagaaaggatcggctaacttcgtgccagcagccgcggtaagacgagggatcctagcgttgttcggaattattgggcgtaaagcggatgtaggtggctttgtaagtcaggtgtgaaagcctagggctcaaccctagaagtgcatctgatactgcgaagcttgagtgtgggagaggatagtagaattcctggtgtagtggtgaaatacgtagatatcaggaggaataccggaggcgaaggcggctatctggcccaacactgacactgagatccgaaagcgtggggatcaaacaggattagataccctggtagtccacgccgtaaacgatggatacttgttgttggaggtattgaccccttcagtgacgaagctaacgcgttaagtatcccgcctggggagtacggtcgcaagattaaaactcaaagaaattgacgggggcccgcacaagcggtggagcatgtggtttaattcgatgcaacgcgaagaaccttacctaggcttgacatgtactggaagactggcagaaatgtcgtcgccttcgggccggtacacaggtgctgcatggctgtcgtcagctcgtgtcgtgagatgttgggttaagtcccgcaacgagcgcaacccctgcatttagttgccagcattcagttgggcactctagatggactgccggtgttaaaccggaggaaggtggggatgacgtcaagtcctcatggcccttatgcctagggctacacacgtgctacaatggtggttacagacggatgccaaaccgcaaggtggagctaatcctacaaaagccatctaagttcagattggtctctgcaactcgagaccatgaagttggaatcgctagtaatcgcggatcagaatgccgcggtgaatacgttcccgggccttgtacacaccgcccgtcacaccatgaaagttggttgtaccagaagtcgctgcgctaaccgtaaggaggcaggcgcccaaggtatggtcgatgattggggt

SEQ ID NO: 345 - DNA, 1289 bp, Bifidobacteriaceae genomosp. C1
cgctggcggcgtgcttaacacatgcaagtcgagcgagcggcgaacgggtgagtaatgcgtgactgacctgccctgaggtttggaatagctcctggaaacgggtggtaatgccggatgttgaaaagtgccttgggatggggtcgcgtcctatcaggtagtcggtggggtagtggcctaccgagcctacgacgggtagccggcctgagagggtgaccggccacattgggactgagatacggcccagactcctacgggaggcagcagtggggaatattgcgcaatgggggaaaccctgacgcagcgacgccgcgtgcgggatggaggccttcgggttgtgaaccgcttttgttagggagcatgagtgtacctttcgaataaggaccggctaactacgtgccagcagccgcggtaatacgtagggtccaagcgctgtccggaattattgggcgtaaagggctcgtaggcggttcgtcgcgtctggtgtgaaagcccattgcttaacggtgggtttgcgctggatacgggcgggcttgagtgcggtaggggagaacggaattcccggtgtaacggtggaatgtgtagatatcgggaagaacaccgatggcgaaggcagttctctgggccgactgacgctgaggagcgaaagcgtggggagcgaacaggattagataccctggtagtccacgctgtaaacggtggatgctggatgtggggcgttctgtgtcggagctaacgcgttaagcatcccgcctggggagtacggccgcaaggttaaaactcaaagaaattgacgggggcccgcacaagcggcggagcatgcggtttaattcgatgcaacgcgaagaaccttacctgggtttgacatgcacaggtggtgcatggccgtcgtcagctcgtgtcgtgagatgttgggtcaagtcccgcaacgagcgcaacccttgccctgtgttgccagcagctgggcactcacgggggaccgccggggttaacccggaggagggtggggatgacgtcaggtcatcatgccccttacgtccagggctacacgcatgctacaatggccggcagcgggatgcgatgtcgtgaggcggagcggatcccttccggtctcagttcggacggagcctgcaactcggctccggaaggtggagtcgctagtaatcgcggatcagcaacgccgcggtgaatgcgttcccgggccttgtacacaccgcccgtcaagtcatgaaagtcggcaacacccgaagcccgtgcctagggagcggtcgaaggtggggctggtgattggg

SEQ ID NO: 346 - DNA, 1021 bp, Bifidobacterium adolescentis
  modified_base (773)..(773): a, c, t, g, unknown or other
  modified_base (859)..(859): a, c, t, g, unknown or other
  modified_base (975)..(975): a, c, t, g, unknown or other
  modified_base (991)..(992): a, c, t, g, unknown or other
  modified_base (1015)..(1015): a, c, t, g, unknown or other
tcccaggagcttgctcctgggtgagagtggcgaacgggtgagtaatgcgtgaccgacctgccccatacaccggaatagctcttggaaacgggtggtaatgccggatgctccagttggatgcatgtccttctgggaaagattcatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcgganccaacgcgttaagcatcccgcctggggagtacggccgcaaggctaaaactcaaagaaattgacgggggcccgcacaagcggcggancatgcggattaattcgatgcaacgcgaagaaccttacctgggcttgacatgttcccgacagccgtagagatacggtctcccttcggggcgggttcacaggtggtgcatggtcgtcntcagctcgtgtcgtgnnatgttgggttaagtcccgcaacnagcgca

SEQ ID NO: 347 - DNA, 1535 bp, Bifidobacterium angulatum
tttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccgtacaccggaatagctcctggaaacgggtggtaatgccggatgctccagtccatcgcatggtggtctgggaaagattttatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgttggggagcaagccttcgggtgagtgtacccttcgaataagcaccggctaactacgtgccagcagccgcggtaatacgtagggtgcaagcgttatccggaattattgggcgtaaagagctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccattccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccccgtgttgccagcacatgatggtgggaactcacgggggaccgccggggttaactcggaggaaggtggggatgacgtcagatcatcatgccccttacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggtagcacccgaagccggtggcccaaccagttcgctggggggagccgtctaaggtgagactcgtgattgggactaagtcgtaacaaggtagccgtaccggaaggtgcggctggatcacctcctttct

SEQ ID NO: 348 - DNA, 1550 bp, Bifidobacterium animalis
tttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgcccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggaga

SEQ ID NO: 349 - DNA, 1056 bp, Bifidobacterium bifidum
  modified_base (764)..(764): a, c, t, g, unknown or other
  modified_base (850)..(850): a, c, t, g, unknown or other
  modified_base (919)..(919): a, c, t, g, unknown or other
  modified_base (961)..(961): a, c, t, g, unknown or other
  modified_base (985)..(985): a, c, t, g, unknown or other
  modified_base (989)..(989): a, c, t, g, unknown or other
  modified_base (993)..(993): a, c, t, g, unknown or other
  modified_base (1002)..(1002): a, c, t, g, unknown or other
  modified_base (1014)..(1014): a, c, t, g, unknown or other
  modified_base (1026)..(1026): a, c, t, g, unknown or other
  modified_base (1028)..(1029): a, c, t, g, unknown or other
  modified_base (1045)..(1045): a, c, t, g, unknown or other
ctttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcgganctaacgcgttaagcgtcccgcctggggagtacggccgcaaggctaaaactcaaagaaattgacgggggcccgcacaagcggcggancatgcggattaattcgatgcaacgcgaagaaccttacctgggcttgacatgttcccgacgacgccaganatggcgtttcccttcggggcgggttcacaggtggtgcatggncgtcgtcagctcgtgtcgtgagangttngggntaagtcccncaacgagcgcanccctcgccccgngnngccagcacgttatggnggggaactcac

SEQ ID NO: 350 - DNA, 1535 bp, Bifidobacterium breve
tttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttct

SEQ ID NO: 351 - DNA, 1051 bp, Bifidobacterium catenulatum
  modified_base (817)..(817): a, c, t, g, unknown or other
  modified_base (935)..(935): a, c, t, g, unknown or other
  modified_base (966)..(967): a, c, t, g, unknown or other
  modified_base (978)..(978): a, c, t, g, unknown or other
  modified_base (1030)..(1030): a, c, t, g, unknown or other
  modified_base (1042)..(1043): a, c, t, g, unknown or other
tcgaacgggatccaggcagcttgctgcctggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggncgcaaggctaaaactcaaagaaattgacgggggcccgcacaagcggcggagcatgcggattaattcgatgcaacgcgaagaaccttacctgggcttgacatgttcccgacagccgtanagatgcggcctcccttcggggcgggttcacnntggtgcatggncgtcgtcagctcgtgtcgtgagatgttgggttaagtcccgcaacgagcgcancctcgccctgtnngccagcac

SEQ ID NO: 352 - DNA, 1539 bp, Bifidobacterium dentium
ttttcgtggagggttcgattctggctcaggatgaacgctggcggcgtgcttaacacatgcaagtcgaacgggatcccgggggttcgcctccgggtgagagtggcgaacgggtgagtaatgcgtgaccgacctgccccatacaccggaatagctcctggaaacgggtggtaatgccggatgctccggttggatgcatgtccttccgggaaaggttccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacccttctgtgggatggagccgtctaaggtgaggctcgtgattgggactaagtcgtaacaaggtagccgtaccggaaggtgcggctggatcacctcctttctacgg

SEQ ID NO: 353 - DNA, 1551 bp, Bifidobacterium gallicum
tttttgtggagggttcgattctggctcaggatgaacgctggcggcgtgcttaacacatgcaagtcgaacgggatccggccgagcttgtcttggctggtgagagtggcgaacgggtgagtaatgcgtgaccaacctgccttgtgcaccggaatagctcctggaaacgggtggtaataccggatgttccgctccatcgcatggtggtgtgggaaatgcttttgcggcatgggatggggtcgcgtcctatcagcttgttggcggggtgacggcccaccaaggctttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgattgtcagcaaggcgtcctttcggggatgttgagtgtagctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttccggatcgccccagagatggggtttcccttcggggccggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggtcaactcggaggaaggtggggatgacgtcagatcatcatgccccttacgtccagggcttcacgcatgctacaatggccggtacaacgggatgcgacaccgtgaggtggggcggatccctgaaaaccggtctcagttcggatcgcagtctgcaacccgactgcgtgaaggcggagtcgctagtaatcgcagatcagcaacgctgcggtgaatgcgttcccgggccttgtacacaccgcccgtcaagtcatgaaagtgggtagcacccgaagccggtggcccgaccgccttgtgtggggggagccgtctaaggtgagactcgtgattgggactaagtcgtaacaaggtagccgtaccggaaggtgcggctggatcacctcctttctacgg

SEQ ID NO: 354 - DNA, 1400 bp, Bifidobacterium infantis
gattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagccgtggggagcgaacaggattagataccctggtagtccacgccgtaaacggtggatgctggatgtggggcccgttccacgggttccgtgtcggagctaacgcgttaagcatcccgcctggggagtacggccgcaagctaaaaactcaaagaaattgacgggggcccgcacaagcggcggagcatgcggattaattcgatcgaacgcgaagaaccttacctgggcttgacatgttcccgacggtcgtagagatacggcttcccttcggggcgggttcacaggtggtgcatggtcgtcgtcacgtcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggtagcacccg

SEQ ID NO: 355 - DNA, 1013 bp, Bifidobacterium kashiwanohense
  modified_base (19)..(19): a, c, t, g, unknown or other
  modified_base (21)..(21): a, c, t, g, unknown or other
  modified_base (29)..(29): a, c, t, g, unknown or other
  modified_base (45)..(47): a, c, t, g, unknown or other
  modified_base (947)..(947): a, c, t, g, unknown or other
gcgggatgacgccttcggntntaaaccgntttgatcgggagcaannncgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgaccgctccagagatggggcttcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggngaatgcgttcccgggccttgtacacaccgcccgtcaagtcatgaaagtgggtagcacccgaagccg

SEQ ID NO: 356 - DNA, 1346 bp, Bifidobacterium longum
cttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcagcgagagtgagtttacccgttgaataagcaccggcaactacgtgccagcagccgcggtaatacgtaggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaatcatcgctgggtctgcgccggttccgggcgggcttgagtgcgggagtgccgtctgggatggctggtgtgaggtgcatgggcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacc

SEQ ID NO: 357 - DNA, 1357 bp, Bifidobacterium pseudocatenulatum
acgggatccatcaggctttgcttggtggtgagagtggcgaacgggtgagtaatgcgtgaccgacctgccccatacaccggaatagctcctggaaacgggtggtaatgccggatgctccggcctgccgcatggtgggctgggaaagattgtatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcggggagtgtacctttcaataacaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggatcatgcggattaattcgatgcaacgcgaagaaccttacctgggcttgacatgttcccgaccgctccagagatggggcttcccttcggggaggctggaatgccgggtgtagcggtggaatagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtg

SEQ ID NO: 358 - DNA, 1527 bp, Bifidobacterium pseudolongum
  modified_base (1526)..(1526): a, c, t, g, unknown or other
ttcgattctggctcaggatgaacgctggcggcgtgcttaacacatgcaagtcgaacgggatccctggcagcttgctgccggggtgagagtggcgaacgggtgagtaatgcgtgaccgacctgccccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgactgcgtgaaggtggagtcgctagtaatcgcggatcagcaacgccgcggtgaatgcgttcccgggccttgtacacaccgcccgtcaagtcatgaaagtgggcagcacccgaagacggtggcctaacccttgtggggggagccgtctaaggtgaggctcgtgattgggactaagtcgtaacaaggtagccgtaccggaaggtgcggctggatcacctcctna

SEQ ID NO: 359 - DNA, 1380 bp, Bifidobacterium scardovii
gaacgctggcggcgtgcttaacacatgcaagtcgaacgggatccggccagcttgctggttggtgagagtggcgaacgggtgagtaatgcgtgaccgacctgccccatgctccggaatagctcctggaaacgggtggtaatgccggatggtccagcatgctgcatggcgtgttgggaaagatttatcggcgtgggatggggtcgcgtcctatcagcttgacggtggggtgatggcctaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttagcagggagcaaggcttcggttgagtgtacctgttgaataagcaccggctaactacgtgccagcagccgcggtaatacgtagggtgcaagcgttatccggaattattgggcgtaaagggctcgtaggcggttcgtcgcgtctggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacggccccagagatggggcttcccttcggggcgggttcacaggtggtgcatggtcgtcgtcagctcgtgtcgtgagatgttgggttaagtcccgcaacgagcgcaaccctcgccccgtgttgccagcattttggatgggaactcacgggggaccgccggggttaactcggaggaaggtggggatgacgtcagatcatcatgcccctacgtccagggcttcacgcatgctacaatggccggtacaacgggatgcgacatggcgacatggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggcagcacc

SEQ ID NO: 360 - DNA, 1363 bp, Bifidobacterium sp. HM2
gggttcgattctggctcaggatgaacgctggcggcgtgcttaacacatgcaagtcgaacgagtggcgaacgggtgagtaatgcgtgaccgacctgccccatgcaccggaatagctcctggaaacgggtggtaatgccggatgctgaaaggcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacacggcgacgtggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcctatggagccgtctaaggtgagactcgtgattgggactaagtcgtaacaaggtagccgtaccggaaggtgcggctggatcacct

SEQ ID NO: 361 - DNA, 1245 bp, Bifidobacterium sp. HMLN12
  modified_base (28)..(28): a, c, t, g, unknown or other
  modified_base (792)..(792): a, c, t, g, unknown or other
  modified_base (1210)..(1210): a, c, t, g, unknown or other
  modified_base (1217)..(1217): a, c, t, g, unknown or other
  modified_base (1219)..(1219): a, c, t, g, unknown or other
  modified_base (1228)..(1228): a, c, t, g, unknown or other
  modified_base (1240)..(1241): a, c, t, g, unknown or other
aacgggagaggatgcgtgaccgacctgncccatgcaccggaatagctcctggaaacgggtggtaatgccggatgttccacatgagcgcatgcgagtgtgggaaaggcttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtgggaagcgaacaggattagataccctggtagtccacgccgtaaacggtggatgctggatgtggggccctttttccgggtcctgtgtcggagctaacgcgttaagcatcccgcctggggagtacggccgcaaggntaaaactcaaagaaattgacgggggcccgcacaagcggcggagcatgcggattaattcgatgcaacgcgaagaaccttacctgggcttgacatgtgcctgacgatcccggagacggggtttcccttcggggcgggttcacaggtggtgcatggtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgantgctaangngcggagtcnctagtaatcgcnnatca

SEQ ID NO: 362 - DNA, 1405 bp, Bifidobacterium sp. M45
  modified_base (1215)..(1215): a, c, t, g, unknown or other
gcttaccatgcagtcgaacgggatcccaggagcttgctcctgggtgagagtggcgaacgggtgagtaatgcgtgaccgacctgccccatacaccggaatagctcctggaaacgggtggtaatgccggatgctccagttgaatgcatgtccttctgggaaagattttgcggtatgggatggggtcgcgtcctatcagcttgatggcggggtaacggcccaccatggcttccacgggtagccggcctgagagggcgaccggccacattgggactgaaatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaagcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccccagagatggggcctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacactgtgaggtggagcggntcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttgggggagccgtctaag

SEQ ID NO: 363 - DNA, 1267 bp, Bifidobacterium sp. MSX5B
gctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgaaggccttcgggttgtaaaccgcttttgatcgggagcatgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggcgttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcagcgggatgcgacatggcgacatggagcggatccctgccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggcagcacccgaagccggtgcctatggagccgtct

SEQ ID NO: 364 - DNA, 1303 bp, Bifidobacterium sp. TM-7
tggctcaggatgaacgctggcggcgtgcttaacacatgcaagtcgaacgagtggcgaacgggtgagtaatgcgtgaccgacctgccccatacaccggaatagctcctggaaacgggtggtaatgccggatgctgaaagtcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcatgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgactgacgctgaggagcgaaagcgtggggagcgaacaggattagataccctggtagtccacgccgtaaacggtggatgctggatgtggggatctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgcacaggtggtgcatggtcgtcgtcagctcgtgtcgtgagatgttgggttaagtcccgcaacgagcgcaaccctcgccctgtgttgccagcacgtgggaactcacgggggaccgccggggtcaactcggaggaaggtggggatgacgtcagatcatcatgccccttacgtccagggcttcacgcatgctacaatggccggcaacgggatgcgacactgtgaggtggagcggatcccttccggtctcagttcggatggagtctgcaacccgactccagaaggcggagtcgctagtaatcgcggatcagcaacgccgcggtgaatgcgttcccgggccttgtacacaccgcccgtcaagtcatgaaagtgggtagcacccgaagccggtgcccagggagccgtctaaggtgagactcgtgattggg

SEQ ID NO: 365 - DNA, 1392 bp, Bifidobacterium thermophilum
tggctcaggatgaacgctggcggcgtgcttaacacatgcaagtcgaacgggatcctgcaagcttgcttgcgggtgagagtggcgaacgggtgagtaatgcgtgaccaacctgccccatgctccggaatagctcctggaaacgggtggtaatgccggatgtgccgggctcctgcatgggggtccgggaaagctctggcggcgtgggatggggtcgcgtcctatcagcttgttggcggggtgagggcccaccaaggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgtttgggagcaagcccttcggggtgagtgtacctttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgacggcggagacgtcgtttcccttcggggcgggttcacaggtggtgcatggtcgtcgtcagctcgtgtcgtgagatgttgggtcaagtcccgcaacgagcgcaaccctcgccccgtgttgccagcgcgtcatggcgggaactcacgggggaccgccggggttaacccgggaggaaggtggggatgacgtcagatcatcatgccccttacgtccagggcttcacgcatgctacaatggccggtacaacgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagc

SEQ ID NO: 366 - DNA, 1412 bp, Bifidobacterium urinalis
ctggctcaggacgaacgctggcggcgtgcttaacacatgcaagtcgaacgggatcctttcaagcttgctaggggggtgagagtggcgaacgggtgagtaacgcgtgattaacctgccgtgtagtttggaatagctcctggaaacgggtggtaatgccgaatgttccacatgctcgcatgggtgtgtgggaaaacgttttagtgctatgcgatgggatcgcgtcctatcagcttgttggtggggtagtggcctaccaaggcttcgacgggtagccggcctgagagggcgaccggccacattgggactgagatacggcccagactcctacgggaggcagcagtggggaatattgcacaatggggggaaccctgatgcagcgacgccgcgtgcgggatgacggccttcgggttgtaaaccgcttttattggggagcaagcgtgagtgagtgtaccttttgaataagcaccggctaactacgtgccagcagccgcggtaatacgtagggtgcaagcgttgtccggaattattgggcgtaaagagctcgtaggcggtttgtcgcgtctggtgtgaaagtccatcgcttaacggtggattggcgcttggtacgggcaggctagagtgtagtaggggagactggaattctcggtgtaacggtggaatgtgtagatatcgggaagaacaccaatggcgaaggcaggtctctgggctattactgacgctgaggagcgaaagcgtggggagcgaacaggattagataccctggtaatccacgccgtaaacggtggatgctggatgtggggccctttccacgggttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttaccaagacttgacatgttaacgatggcctcagagatggggtgtctcttcggagcgttttcacaggtggtgcatggtcgtcgtcagctcgtgtcgtgagatgttgggttaagtcccgcaacgagcgcaacccttgtcttgtgttgccagcacgttatggtgggaactcacaagagaccgccggggttaactcggaggaaggtggggatgacgtcagatcatcatgccccttacgtcttgggcttcacgcatgctacaatggccggtacagcgaggtgcgatagggtgacctggagcggatctctgaaaaccggtctcagttcggatcggagcctgcaactcggctccgtgaaggtggagtcgctagtaatcgcagatcagcaacgctgcggtgaatgcgttcccgggccttgtacacaccgcccgtcaagtcatgaaagtgggcagcacccgaagccggtggccta

SEQ ID NO: 367 - DNA, 1551 bp, Bilophila wadsworthia
tcaactggagagtttgattctggctcagattgaacgctggcggcgtgcttaacacatgcaagtcgaacgtgaaagtccttcggggcgagtaaagtggcgcacgggtgagtaacgcgtggataatctacccttaagatggggataacggctggaaacggtcgctaataccgaatacgctcccgattttatcgttggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctcctt

SEQ ID NO: 368 - DNA, 1296 bp, Bisgaard Taxon
attgaacgctggcggcaggcttaacacatgcaagtcgaacgagtggcggacgggtgagtaatgcttgggaatctggcttatggagggggataactgcgggaaactgcagctaataccgcgtattgaaagctgccataagatgagcccaagtgggattaggtagttggtggggtaaaggcctaccaagccgacgatctctagctggtctgagaggatgaccagccacactgggactgagacacggcccagactcctacgggaggcagcagtggggaatattgcgcaatgggggaaaccctgacgcagccatgccgcgtgaatgaagaaggccttcgggttgtaaagttctttcggtaatgaggatgacgttaattacagaagaagcaccggctaactccgtgccagcagccgcggtaatacggagggtgcgagcgttaatcggaataactgggcgtaaagggcccgcaggcggacttttaagtgagatgtgaaatccctgggcttaacctaggaactgcatttcagactgggagtctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccagtgacaaactggaggaaggtggggatgacgtcaagtcatcatggcccttacgagtagggctacacacgtgctacaatggtgcacagagggcggcgagacggcgacgttgagcgaatctcagtgcatctaagtccggatggagtctgcaactcgactccagaagtcggaatcgctagtaatcgcaaatcagaatgttgcggtgaatacgttcccgggccttgtacacaccgcccgtcacaccatgggagtgggttgtaccagaagtagatgcttagggcgtttaccacggtatgattcatgactggggtg

SEQ ID NO: 369 - DNA, 1296 bp, Bisgaard Taxon; identical to SEQ ID NO: 368

SEQ ID NO: 370 - DNA, 1296 bp, Bisgaard Taxon; identical to SEQ ID NO: 368

SEQ ID NO: 371 - DNA, 1296 bp, Bisgaard Taxon; identical to SEQ ID NO: 368

SEQ ID NO: 372 - DNA, 1477 bp, Blastomonas natatoria
agagtttgatcctggctcagaacgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgacttcggtccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggccattcaagtcagaggtgaaagcccggggctcaaccccggaactgcctttgaaactagatggcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtctagtatgtttcccagagatgggttacttcagttcggctggctagaacacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacacgctgggctacacacgtgctacaatggcggtgacagtgagcagctagatcgcgagatcatgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacct

SEQ ID NO: 373 - DNA, 1493 bp, Blautia coccoides
agagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtaacc

SEQ ID NO: 374 - DNA, 1362 bp, Blautia glucerasea
  modified_base (944)..(944): a, c, t, g, unknown or other
tggaagcttcggtggaaatagcttgttcctagtggcggacgggtgagtaacgcgtgggtaacctgcctcacactgggggataacagtcagaaatgactgctaataccgcataagcgcacgggattgcatgatccagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtgcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctatgaccggcgagtaacgtcgccttttcttcggagcngaggagacaggtggtgcatggttgtcgtcagctcgtgtcgtgagatgttgggttaagtcccgcaacgagcgcaacccctatccttagtagccagcggtttggccgggcactctgaggagactgccagggataacctggaggaaggcggggatgacgtcaaatcatcatgccccttatgatttgggctacacacgtgctacaatggcgtaaacaaagggaagcgagagtgtgagcttaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgaccgaaccgaaagg

SEQ ID NO: 375 - DNA, 1026 bp, Blautia glucerasei
  modified_base (10)..(10): a, c, t, g, unknown or other
  modified_base (37)..(39): a, c, t, g, unknown or other
  modified_base (861)..(861): a, c, t, g, unknown or other
  modified_base (932)..(934): a, c, t, g, unknown or other
  modified_base (941)..(943): a, c, t, g, unknown or other
  modified_base (950)..(951): a, c, t, g, unknown or other
  modified_base (953)..(953): a, c, t, g, unknown or other
  modified_base (957)..(957): a, c, t, g, unknown or other
  modified_base (965)..(965): a, c, t, g, unknown or other
  modified_base (967)..(967): a, c, t, g, unknown or other
  modified_base (970)..(972): a, c, t, g, unknown or other
  modified_base (991)..(992): a, c, t, g, unknown or other
  modified_base (1019)..(1019): a, c, t, g, unknown or other
cgaacggggnacattttattggaagcttcggctaggnnntatagcttgttcctagtggcggacgggtgagtaacgcgtgggtaacctgcctcacactgggggataacagtcagaaatgactgctaataccgcataagcgcacgggattgcatgatccagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaggcaggggctcaacccctggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacgggganccgcacaagcggtggagcatgtggtttaattcgaagcaacgcgaagaaccttaccaagtcttgacatcccnnngaccggnnngtaacgnngncttnctcttcgnancannngagacaggtggtgcatggnngtcgtcagctcgtgtcgtgagatgttnggttaag

SEQ ID NO: 376 - DNA, 1157 bp, Blautia hansenii
agagtttgatcctggctcaggatgaacgctggcggcgtgcttaacacatgcaagtcgagcgaagcacttatcattgactcttcggaagatttgatatttgactgagcggcggacgggtgagtaacgcgtgggtaacctgcctcatacaggggaataacagttagaaatggctgctaatgccgcataagcgcacaggatcgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccgttccttgaccggagctttccttcgggacaggcaagacaggtggtgcatggttgtcgtcagctcgtgtcgtgagatgttgggttaagtcccgcaacgagcgcaacccctatccttagtagccagcagttcggctgggcactctagggagactgccggggataacccgg

SEQ ID NO: 377 - DNA, 975 bp, Blautia hydrogenotrophica
  modified_base (23)..(23): a, c, t, g, unknown or other
  modified_base (947)..(947): a, c, t, g, unknown or other
  modified_base (952)..(953): a, c, t, g, unknown or other
  modified_base (963)..(964): a, c, t, g, unknown or other
tttcggttgaagttttctattgnctgagtggcggacgggtgagtaacgcgtgggtaacctgccctatacagggggataacagttagaaatgactgctaataccgcataagcgcacagcttcgcatgaagcggtgtgaaaaactgaggtggtataggatggacccgcgttggattagctagttggtgaggtaacggcccaccaaggcgacgatccatagccggcctgagagggtgaacggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagaaagtgacggtacctgactaagaagccccggctaattacgtgccagcagccgcggtaatacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcctgctggacggtaactgacgttgaggctcgaaagcgtggggagcaaacaggattagataccctggtagtccacgctgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggaagtaatgttcccttttcttcggaacagagganacagnnggtgcatggnngtcgtcagctc

SEQ ID NO: 378 - DNA, 998 bp, Blautia luti
  modified_base (33)..(33): a, c, t, g, unknown or other
  modified_base (765)..(767): a, c, t, g, unknown or other
  modified_base (771)..(775): a, c, t, g, unknown or other
  modified_base (915)..(916): a, c, t, g, unknown or other
  modified_base (929)..(929): a, c, t, g, unknown or other
  modified_base (940)..(940): a, c, t, g, unknown or other
  modified_base (949)..(949): a, c, t, g, unknown or other
  modified_base (958)..(958): a, c, t, g, unknown or other
  modified_base (966)..(968): a, c, t, g, unknown or other
  modified_base (972)..(973): a, c, t, g, unknown or other
  modified_base (975)..(976): a, c, t, g, unknown or other
  modified_base (979)..(979): a, c, t, g, unknown or other
  modified_base (981)..(981): a, c, t, g, unknown or other
  modified_base (984)..(985): a, c, t, g, unknown or other
  modified_base (991)..(992): a, c, t, g, unknown or other
tcgaacgggaattactttattgaaacttcggtngatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggnnncatnnnnncttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccanntcttgacatcccnctgaccggatnctttaatcnggatctttnccttcggnnnaganngnnacngnggnncatggnngtcgtc

SEQ ID NO: 379 - DNA, 1393 bp, Blautia producta
  modified_base (10)..(10): a, c, t, g, unknown or other
  modified_base (15)..(16): a, c, t, g, unknown or other
  modified_base (42)..(42): a, c, t, g, unknown or other
agcgaagcancttgnncggatttcttcggattgaagtttttngtgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagttcagtgacccaaccttataggagggagct

SEQ ID NO: 380 - DNA, 1366 bp, Blautia schinkii
tgacagagacttcggttgaagtcgttataatcctagtggcggacgggtgagtaacgcgtgggtaacctgcctcacactgggggataacagtcagaaatgactgctaataccgcataagcgcacggggctgcatggttcagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgtatccggatttactgggtgtaaagggagcgtagacggagcagcaagtctgatgtgaaaggcgggggctcaacccccggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctatgaccggtgagtaacgtcacctttccttcgggacagaggagacaggtggtgcatggttgtcgtcagctcgtgtcgtgagatgttgggttaagtcccgcaacgagcgcaacccctatccttagtagccagcggtttggccgggcactctgaggagactgccagggataacctggaggaaggcggggatgacgtcaaatcatcatgccccttatgatttgggctacacacgtgctacaatggcgtaaacaaagggaagcgagagtgtgagcttaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgaccgaaccgaaagg

SEQ ID NO: 381 - DNA, 1015 bp, Blautia sp. M25
  modified_base (77)..(77): a, c, t, g, unknown or other
gaaggaagaagtatctcggtatgtaaacttctatcagcagggaagataatgacggtacctgactaagaagccccggnctaactacgtgccagcagccgcggtaatacgtagggggcgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtctgggagcacagctcttaggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgacagagtatgtaatgtacttttccttcgggacaggggagacaggtggtgcatggttgtcgtcagctcgtgtcgtgagatgttgggttaagtcccgcaacgagcgcaacccctatccttagtagccagcaagtaatgttgggcactctgaggagactgccagggataacctggaggaaggcggggatgacgtcaaatcatcatgccccttatgatttgggctacacacgtgctacaatggcgtaaacaaagggaagcgaacctgtgagggtgggcaaatctcaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgac

SEQ ID NO: 382 - DNA, 1372 bp, Blautia stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 383 - DNA, 1375 bp, Blautia wexlerae
  modified_base (12)..(13): a, c, t, g, unknown or other
  modified_base (17)..(17): a, c, t, g, unknown or other
  modified_base (21)..(21): a, c, t, g, unknown or other
  modified_base (27)..(27): a, c, t, g, unknown or other
  modified_base (47)..(47): a, c, t, g, unknown or other
  modified_base (917)..(917): a, c, t, g, unknown or other
  modified_base (958)..(958): a, c, t, g, unknown or other
tcgaacgggaanntatnttcnattganacttcggtggatttagattntatttcgtagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccacagccgcgaagggggcagcgttatccggatttactgggtgtaaagggagcgtagacggtgtggcaagttgatgtgaaaggcatgggctcaacctgtggatgcattggaaactgtcatacttgagtgccggaggggtaagcggaattctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaccttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccnatttaacgggtcttaaaggggcgtttacgttggggaaagtntgatatgagaggcatgtgcttaacctgctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaag

SEQ ID NO: 384 - DNA, 1464 bp, Bordetella bronchiseptica
  modified_base (87)..(87): a, c, t, g, unknown or other
  modified_base (160)..(160): a, c, t, g, unknown or other
  modified_base (243)..(243): a, c, t, g, unknown or other
  modified_base (331)..(331): a, c, t, g, unknown or other
  modified_base (380)..(380): a, c, t, g, unknown or other
  modified_base (958)..(958): a, c, t, g, unknown or other
  modified_base (1287)..(1287): a, c, t, g, unknown or other
  modified_base (1391)..(1391): a, c, t, g, unknown or other
  modified_base (1409)..(1409): a, c, t, g, unknown or other
aactgaagagtttgatcctggctcagattgaacgctggcgggatgctttacacatgcaagtcggacggcagcacgggcttcggcctngtggcgagtggcgaacgggtgagtaatgtatcggaacgtgcccagtagcgggggataactacgcgaaagcgtngctaataccgcatacgccctacgggggaaagcgggggaccttcgggcctcgcactattggagcggccgatatcggattagctngttggtggggtaacggcctaccaaggcgacgatccgtagctggtttgagaggacgaccagccacactgggactgagacacggcccagnctcctacgggaggcagcagtggggaattttggacaatgggggcaacccngatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatncaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtngtccggatcgcagtctgcaactcgactgcgtgaagtcggaatcgctagtaatcgcggatcagcatgtcgcggtgaatacgttcccgggtcttgtacacaccgcncgtcacaccatgggagtnggttttaccagaagtagttagcctaaccgcaaggggggcgattaccacggtagga

SEQ ID NO: 385 - DNA, 1292 bp, Bordetella holmesii
attgaacgctggcgggatgctttacacatgcaagtcggacgagtggcgaacgggtgagtaatgtatcggaacgtgcccggtagcgggggataactacgcgaaagcgtggctaataccgcatacggaaaggcactattggagcggccgatatcggattagctagttggtggggtaacggcctaccaaggcgacgatccgtagctggtttgagaggacgaccagtcacactgggactgagacacggcccagactcctacgggaggcagcagtggggaattttggacaatgggggcaaccctgatccagccatcccgcgtgtgcgatgaaggccttcgggttgtaaagcacttttggcaggaaagatgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgagctagagtgtgtcagagggaggtggaattccgcgtgtagcagtgaaatgcgtagatatgcggaggaacaccgatggcgaaggcagcctcctgggataactgacgctcatgcacgaaagtgtggggagcaaacaggattagataccctggtagtccacgccctaaacgatgtcaactagctgttggggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgcacaggtgctgcatggctgtcgtcagctcgtgtcgtgagatgttgggttaagtcccgcaacgagcgcaacccttgtcattagttgctacggcactctaatgagactgccggtgacaaaccggaggaaggtggggatgacgtcaagtcctcatggcccttatgggtagggcttcacacgtcatacaatggtcggcagagggttgccaacccgcgagggggagccaatcccagccggtcgtagtccggacgcagtctgcaactcgactgcggaagtcggaatcgctagtaatcgcggatcagcatgtcgcggtgaatacgttcccgggtcttgtacacaccgcccgtcacaccatgggagtgggttttaccagaagtagttgcctagggcgattaccacggtaggattcatgactggggtgaa

SEQ ID NO: 386 - DNA, 1464 bp, Bordetella parapertussis
  modified_base (87)..(87): a, c, t, g, unknown or other
  modified_base (243)..(243): a, c, t, g, unknown or other
  modified_base (331)..(331): a, c, t, g, unknown or other
  modified_base (1229)..(1229): a, c, t, g, unknown or other
  modified_base (1371)..(1371): a, c, t, g, unknown or other
  modified_base (1391)..(1391): a, c, t, g, unknown or other
aactgaagagtttgatcctggctcagattgaacgctggcgggatgctttacacatgcaagtcggacggcagcacgggcttcggcctngtggcgagtggcgaacgggtgagtaatgtatcggaacgtgcccagtagcgggggataactacgcgaaagcgtagctaataccgcatacgccctacgggggaaagcgggggaccttcgggcctcgcactattggagcggccgatatcggattagctngttggtggggtaacggcctaccaaggcgacgatccgtagctggtttgagaggacgaccagccacactgggactgagacacggcccagnctcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatngtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcncgggtcttgtacacaccgcncgtcacaccatgggagtgggttttaccagaagtagttagcctaaccgcaaggggggcgattaccacggtagga

SEQ ID NO: 387 - DNA, 1533 bp, Bordetella pertussis
ttgaactgaagagtttgatcctggctcagattgaacgctggcgggatgctttacacatgcaagtcggacggcagcacgggcttcggcctggtggcgagtggcgaacgggtgagtaatgtatcggaacgtgcccagtagcgggggataactacgcgaaagcgtggctaataccgcatacgccctacgggggaaagcgggggaccttcgggcctcgcactattggagcggccgatatcggattagctagttggtggggtaacggcctaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagtgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatcccagaaacccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 388 - DNA, 1533 bp, Borrelia afzelii
gaagagtttgatcctggcttagaactaacgctggcagtgcgtcttaagcatgcaagtcaaacggaatgtagcaatacatttagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaagacgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagcgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggagctatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtaggtagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcacaaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 389 - DNA, 1533 bp, Borrelia burgdorferi
gaagagtttgatcctggcttagaactaacgctggcagtgcgtcttaagcatgcaagtcaaacgggatgtagcaatacattcagtggcgaacgggtgagtaacgcgtggatgatctacctatgagatggggataactattagaaatagtagctaataccgaataaggtcagttaatttgttaattgatgaaaggaagcctttaaagcttcgcttgtagatgagtctgcgtcttattagctagttggtagggtaaatgcctaccaaggcaatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 390 - DNA, 1299 bp, Borrelia crocidurae
cctggcttagaactaacgctggcagtgcgtcttaagcatgcaagtcagacgagtggcgaacgggtgagtaacgcgtggataatctacctatgagatggggataactattagaaatagtagctaataccgaataaggaaagtcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggatgacgttaatttatgaataagccccggctaattacgtgccagcagccgcggtaatacgtaaggggcgagcgttgttcgggattattgggcgtaaagggtgagtaggcggatatgcaagtctggcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaactgacgctgagtcacgaaagcgtagggagcaaacaggattagataccctggtagtctacgctgtaaacgatgcacacttggtgttaatcggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggtgctgcatggttgtcgtcagctcgtgctgtgaggtgttgggttaagtcccgcaacgagcgcaacccttattgtctgttaccagcatatggggactcagacgagactgccggtgataagccggaggaaggtgaggatgacgtcaaatcatcatggcccttatgtcctgggctacacacgtgctacaatggcctgcaaagcgatgcgaaacagtgatgtgaagcaaaacgcatcaggtctcagtccagatgaagtctgaaactcgacttcagaagttggaatcgctagtaatcgtatatcagaatgatacggtgaatacgttctcgggccttgtacacaccgcccgtcacaccacccgagttgaggatacccgaagctattttctaggaaggtatctaaggtatgtttagtga

SEQ ID NO: 391 - DNA, 1534 bp, Borrelia duttonii
gaagagtttgatcctggcttagaactaacgctggcagtgcgtcttaagcatgcaagtcaaacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagcttcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgcaagtctgtgcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgagaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcctttct

SEQ ID NO: 392 - DNA, 1533 bp, Borrelia garinii
gaagagtttgatcctggcttagaactaacgctggcagtgcgtcttaagcatgcaagtcaaacgggatgtagcaatacatctagtggcgaacgggtgagtaacgcgtggatgatctacctacgagatggggataactattagaaatagtagctaataccgaataaagtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 393 - DNA, 1273 bp, Borrelia hermsii
gggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaaaagcctaccaaggctgtgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatgcaagtctatgcgtaaaataccacagctcaactgtgggaatatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgaaaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaat

SEQ ID NO: 394 - DNA, 1300 bp, Borrelia hispanica
tcctggcttagaactaacgctggcagtgcgtcttaagcatgcaagtcagacgagtggcgaacgggtgagtaacgcgtggataatctacctatgagatggggataactattagaaatagtagctaataccgaataaggaaagtcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggatgacgttaatttatgaataagccccggctaattacgtgccagcagccgcggtaatacgtaaggggcgagcgttgttcgggattattgggcgtaaagggtgagtaggcggatatgcaagtctagcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaactgacgctgagtcacgaaagcgtagggagcaaacaggattagataccctggtagtctacgctgtaaacgatgcacacttggtgttaatcggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggtgctgcatggttgtcgtcagctcgtgctgtgaggtgttgggttaagtcccgcaacgagcgcaacccttattgtctgttaccagcatatggggactcagacgagactgccggtgataagccggaggaaggtgaggatgacgtcaaatcatcatggcccttatgtcctgggctacacacgtgctacaatggcctgcaaagcgatgcgaaacagtgatgtgaagcaaaacgcatcaggtctcagtccagatgaagtctgaaactcgacttcagaagttggaatcgctagtaatcgtatatcagaatgatacggtgaatacgttctcgggccttgtacacaccgcccgtcacaccacccgagttgaggatacccgaagctattttctaggaaggtatctaaggtatgtttagtga

SEQ ID NO: 395 - DNA, 1526 bp, Borrelia persica
agtttgatcctggcttagaactaacgctggcagtgcgtcttaagcatgcaagtcagacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagcttcgcttgtagatgagtctgcgtcttattagctagttggtggggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgcaagtctatgcgtaaaataccacagctcaactgtggagctatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaattgagagattagtaccgaagctaacgtgttaagtgtgccgcctggggagtatgctcgcaagagtgaaactcaaaggaattgacgggggcccgcacaagcggtggagcatgtggtttaattcgatgatacgcgagaaaccttaccagggcttgacatatacaggatgtagttagagataattattccccgtttggggtctgtatacaggtgctgcatggttgtcgtcagctcgtgctgtgaggtgttgggttaagtcccgcaacgagcgcaacccttattgtctgttaccagcatgtaaagatgggaactcagatgagactgccggtgataagccggaggaaggtgaggatgacgtcaaatcatcatggcccttatgccctgggctacacacgtgctacaatggcctgtacaaagcgaagcgaaacagtgatgtgaagcaaaacgcattaaagcaggtctcagtccagattgaagtctgaaactcgacttcatgaagttggaatcgctagtaatcgtatatcagcatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcc

SEQ ID NO: 396 - DNA, 1525 bp, Borrelia recurrentis
agtttgatcctggcttagaactaacgctggcagtgcgtcttaagcatgcaagtcaaacgggatgtagcaatacattcagtggcgaacgggtgagtaacgcgtggataatctacctatgagatggggataactattagaaatagtagctaataccgaataaggtcagttgagatgtcaattgatgaaaggaagcctttaaagctttgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagtcccggctaattacgtgccagcagccgcggtaatacgtaaggggcgagcgttgttcgggattattgggcgtaaagggtgagtaggcggatatgcaagtctgtgcgtaaaataccacagctcaactgtggagctatgctagaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgagaggttagtaccgaagctaacgtgttaagtgtgccgcctggggagtatgctcgcaagagtgaaactcaaaggaattgacgggggcccgtacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattttaacccgcaagggaggaaggtatctaaggtatgtttagtgaggggggtgaagtcgtaacaaggtagccgtactggaaagtgtggctggatcacctcc

SEQ ID NO: 397 - DNA, 1467 bp, Borrelia sp. NE49
ctggcttagaactaacgctggcagtgcgtcttaagcatgcaagtcaaacggaatgtagcaatacattcagtggcgaacgggtgagtaacgcgtggatgatctgcctatgagatggggataactattagaaatagtagctaataccgaataaggtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtg

SEQ ID NO: 398 - DNA, 1531 bp, Borrelia spielmanii
agagtttgatcctggcttagaactaacgctggcagtgcgtcttaagcatgcaagtcaaacgggatgtagcaatacatctagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggcctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcacaaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 399 - DNA, 1532 bp, Borrelia turicatae
agagtttgatcctggcttagaactaacgctggcagtgcgtcttaagcatgcaagtcagacggaatgtagcaatacattcagtggcgaacgggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgtaagtctatgcgtaaaataccacagctcaactgtggaactatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcgaacaggattagataccctggtagtctacgctgtaaacgatgcacacttggtgttaatcgaaaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtggggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcctttct

SEQ ID NO: 400 - DNA, 1533 bp, Borrelia valaisiana
gaagagtttgatcctggcttagaactaacgctggcagtgcgtcttaagcatgcaagtcaaacgggatgtagtaatacatctagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggacatataagtctatgcataaaataccacagctcaactgtggaactatgttggaaactatatgcctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactgaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttct

SEQ ID NO: 401 - DNA, 1512 bp, Brachybacterium alimentarium
  modified_base (11)..(12): a, c, t, g, unknown or other
agagtttgatnntggctcaggacgaacgctggcggcgtgcttaacacatgcaagtcgaacgatgacgaccgagcttgctcggtctgattagtggcgaacgggtgagtaacacgtgagtaacctgccccccacttcgggataacttcgagaaatcgtggctaataccggatatgaacttccgccgcatggtggttgttggaaagtttttcggtgggggatggactcgcggcctatcagtttgttggtgaggtaatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgagggatgacggcctttgggttgtaaacctctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatggaccggacggctgcaaaaatgtggctttcttcggactggttcacaggtggtgcatggttgtcgtcagctcgtgtcgtgagatgttgggttaagtcccgcaacgagcgcaaccctcgttctatgttgccagcgcgttatggcggggactcatgggagactgccggggtcaactcggaggaaggtggggacgacgtcaaatcatcatgccccttatgtcttgggcttcaagcatgctacaatggtcggtacaatgggttgcgaaactgtgaggtggagcgaatcctaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtcgaaggtgggatcggtgattgggactaagtcgtaacaaggtagccgtaccggaaggtgcggctggatcacctccttt

SEQ ID NO: 402 - DNA, 1458 bp, Brachybacterium conglomeratum
tggctcaggacgaacgctggcggcgtgcttaacacatgcaagtcgaacgatgacggtggtgcttgcaccgcctgattagtggcgaacgggtgagtaacacgtgagtaacctgccctccacttcgggataacctcgggaaatcgtggctaataccggatatgagcactcatcgcatggtgggtgttggaaagatttatcggtgggggatggactcgcggcctatcagtttgttggtgaggtgatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacccctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatgcactggacggctgcagagatgtggctttctttggactggtgcacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggacgacgtcaaatcatcatgccccttatgtcttgggcttcaagcatgctacaatggtcggtacaatgggttgcgaaactgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtctaaggtgggatcggtgattgggactaagtcgta

SEQ ID NO: 403 - DNA, 1512 bp, Brachybacterium tyrofermentans
  modified_base (11)..(12): a, c, t, g, unknown or other
agagtttgatnntggctcaggatgaacgctggctgcgtgcttaacacatgcaagtcgaacgatgacgaccgagcttgctcggtctgattagtggcgaacgggtgagtaacacgtgagtaacctgcccctcacttcgggataacctcgagaaattgtggctaataccggatatgaacttccgccgcatggtggttgttggaaagtttttcggtgagggatggactcgcggcctatcagtttgttggtgaggtaatggctcaccaagacgatgacgggtagccggcctgagagggcgaccggccacactgggactgagacacggcccagactcctacgggaggcagcagtggggaatattgcacaatgggcgaaagcctgatgcagcgacgcagcgtgggggatgactgccttcgggttgtaaacctctttcagtagggaagaagcgaaagtgacggtacctgcagaagaagcgccggctaactacgtgccagcagccgcggtaatacgtagggcgcaagcgttatccgtaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactagatgtgggggacattccacgttttccgcgtcgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatggaccggacggctgcagaaatgtggctttcttcggactggttcacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcaagcatgctacaatggtcggtacaatgggttgcgaaactgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtctaaggtgggattggtgattgggactaagtcgtaacaaggtagccgtaccggaaggtgcggctggatcacctccttt

SEQ ID NO: 404 - DNA, 1270 bp, Brachyspira aalborgi
agcgaacgttggcgatgcgtcttaagcatgcaagtcgagcgagcggcgaactggtgagtaacacgtaggtaatctgccgtagagtgggggataacccatggaaacatggactaataccgcatatagaaagccgctttacgatgagcctgcggcctattagcctgttggtgagataaaagcccaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaaccttggaaattatcgaagatgacagtagataatgtaagcctcggctaactacgtgccagcagccgcggtaatacgtaggaggcaaacgttgctcggatttactgggcgtaaagggtgagtaggcggaactataagtctaaggtgaaatatcgaagctcaacttcggagacgcctcggatactgtggttcttggatattgtaggggatgatggaattctcggtgtagcggtggaatgtatagatatcgagaagaacacctatagcgaaggcagtcatctgggcatatcgacgctgaatcacgaaagctgggggagcaaacaggcttagataccctggtagtcccagccgtaaacgttgcacactaggtgctcctaggcgtgccgtagctaacgtcttaagtgtgccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatggctgtcgtcagctcgtgtcgtgagatgttgggttaagtcccgcaacgagcgcaacccttaccctttgttgctaccgatcgggcactcttaggggaccgcctacgttaagtaggaggaaggtggggatgatgtcaagtcctcatggcccttatgtccagggctacacacgtgctacaatggcaaccaaagagaagcgagaccgcgaggtggagcaaatctcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagtcgttgcctagggcggcgccga

SEQ ID NO: 405 - DNA, 1506 bp, Brachyspira pilosicoli
agagtttgattctggctcagagcgaacgttggcgatgcgtcttaagcatgcaagtcgagcgggcttattcgggcaactggataagttagcggcgaactggtgagtaacacgtaggtaatctgccgtgaagcgggggataacccatggaaacatggactaataccgcatatactcttgctacataagtagagtagaggaaagttttttcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagaatgagtgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtaagtcttggatattgtaggggatgatggaattctcggtgtagcggtggaatgcgcagatatcgagaggaacacctatagcgaaggcagtcatctgggcatttatcgacgctgaatcacgaaagctaggggagcaaacaggcttagataccctggtagtcctagccgtaaacgttgtacactaggtgcttctatttaaataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgttagatgaatgatttagagataagtcagaccgcaaggacgtttaacataggtgctgcatggctgtcgtcagctcgtgtcgtgagatgttgggttaagtcccgcaacgagcgcaaccctcaccctctgttgctaccgagtaatgtcgagcactcttaggggactgcctacgttcaagtaggaggaaggtggggatgatgtcaagtcctcatggcccttatgtccagggctacacacgtgctacaatggcaagtacaaagagaagcaagaccgcgaggtggagcaaaactcaaaaaagttgcctcagttcggattggagtctgaaactcgactccatgaagttggaatcactagtaatcgtagatcagaacgctacggtgaatacgttcccggggattgtacacaccgcccgtcacgccatcggagttggttttacctgaagccgttagcctaaccgcaaggagggcggcgtcgaaggtgggactgatgatgagggtgaagtcgtaacaaggcagccgtaccggaaggtgtggctggatcacctccttt

SEQ ID NO: 406 - DNA, 1272 bp, Brachyspira sp. HIS3
agcgaacgttggcgatgcgtcttaagcatgcaagtcgagcgagcggcgaactggtgagtaacacgtaggtaatctgccgtgaagtgggggataacccatggaaacatggactaataccgcatatagaaagtcgcttcacgatgagcctgcggcctattagcctgttggtagggtaatggcctaccaaagctacgataggtagccgacctgagagggtgaccggccacattgggactgagatacggcccagactcmtacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgtaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcga

SEQ ID NO: 407 - DNA, 1325 bp, Brachyspira sp. HIS4
agcgaacgttggcgatgcgtcttaagcatgcaagtcgagcgagcggcgaactggtgagtaacacgtaggtaatctgccgtgaagtgggggataacccatggaaacatggactaataccgtatatagaaagtcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgcaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcgaaggtgggactgatgatgagggtgaagtcgtaacaaggcagccgtaccggaagg

SEQ ID NO: 408 - DNA, 1278 bp, Brachyspira sp. HIS5
gaacgttggcgatgcgtcttaagcatgcaagtcgagcgagcggcgaactggtgagtaacacgtaggtaatctgccgtgaagtgggggataacccatggaaacatggactaataccgcatatagaaagtcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagatgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtagatcttggatattgtaggggatgatggaattctcggtgtagcggtggaatgcgcagatatcgagaggaacacctatagcgaaggcagtcatctgggcatatcgacgctgaatcacgaaagctaggggagcaaacaggcttagataccctggtagtcctagccgtaaacgttgtacactaggtgcttctataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgcataggtgctgcatgcctgtcgtcagctcgtgtcgtgagatgttgggttaagtcccgcaacgagcgcaaccctcaccctctgttgctaccgatcgagtactcttaggggactgcctacgtcaagtaggaggaaggtggggatgatgtcaagtcctcatggcccttatgtccagggctacacacgtgctacaatggcaagcaaagagaagcaagaccgcgaggtggagcaaaactcaagttgcctcagttcggatggagtctgaaactcgactccagaagttggaatcactagtaatcgtagatcagaacgctacggtgaatacgttcccggggattgtacacaccgcccgtcacgccatcggagttggttttacctgaagccgttgcctagggcggcgtcgaaggtgggac

SEQ ID NO: 409 - DNA, 1029 bp, Brevibacillus agri
  modified_base (9)..(9): a, c, t, g, unknown or other
  modified_base (11)..(11): a, c, t, g, unknown or other
  modified_base (22)..(22): a, c, t, g, unknown or other
  modified_base (58)..(60): a, c, t, g, unknown or other
  modified_base (70)..(70): a, c, t, g, unknown or other
aaagttctntntcagagacgancaagtaccgttcgaacagggcggtaccttgacggtnnngacgagaaanccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggaagctagctcgcgagagtatgccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagcca

SEQ ID NO: 410 - DNA, 1461 bp, Brevibacillus brevis
  modified_base (44)..(45): a, c, t, g, unknown or other
  modified_base (54)..(55): a, c, t, g, unknown or other
gacgaacgctggcggcgtgcctaatacatgcaagtcgagcgagnntcttcggannctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaag

SEQ ID NO: 411 - DNA, 1419 bp, Brevibacillus centrosporus
  modified_base (23)..(23): a, c, t, g, unknown or other
  modified_base (27)..(27): a, c, t, g, unknown or other
  modified_base (156)..(156): a, c, t, g, unknown or other
  modified_base (162)..(162): a, c, t, g, unknown or other
  modified_base (180)..(181): a, c, t, g, unknown or other
  modified_base (198)..(198): a, c, t, g, unknown or other
  modified_base (200)..(200): a, c, t, g, unknown or other
  modified_base (212)..(212): a, c, t, g, unknown or other
  modified_base (321)..(321): a, c, t, g, unknown or other
  modified_base (411)..(411): a, c, t, g, unknown or other
  modified_base (450)..(450): a, c, t, g, unknown or other
  modified_base (478)..(478): a, c, t, g, unknown or other
  modified_base (644)..(644): a, c, t, g, unknown or other
  modified_base (717)..(717): a, c, t, g, unknown or other
  modified_base (870)..(870): a, c, t, g, unknown or other
  modified_base (1403)..(1403): a, c, t, g, unknown or other
gagagtttgatcctggctcaggncgancgctggcggcgtgcctaatacatgcaagtcgagcgagtctcttcggaggctagcggcggacgggtgagtaacacgtaggcaacctgcctctcagactgggataacatagggaaacttatgctaataccngatagngtcttgtctcgcatgagnnaagacggaaaggtagcncnggctatcacttncggatgggcctgcggcgcattagctagttggtggggtaatggcctaccaaggcgacgatgcgtagccgacctgagagggtgaccggccacactgggactgagacacggnccagactcctacgggaggcagcagtagggaattttccacaatggacgaaagtctgatggagcaacgccgcgtgaacgatgaaggtcttcngattgtaaagttctgttgttagggacgaacaagtaccgntcgaatagggcggtaccttgacggtacntgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgantgcagaagaggaaagcggtattccacgtgtagcggtgaaatgcgtagagatgtggaggaacaacagtggcganggcggctttctggtctgtaactgacgctgaggcgcgaaagcgtggggagcaaacaggattagataccctggtagtccacgccgcaaacgatgagtgctaggtgttgggggtttcaataccctcagtgccgcagctaacgcaataagcactccncctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacnggagtttgcaacaccc

SEQ ID NO: 412 - DNA, 1486 bp, Brevibacillus choshinensis
  modified_base (44)..(44): a, c, t, g, unknown or other
  modified_base (51)..(51): a, c, t, g, unknown or other
cgaacgctggcggcgtgcctaatacatgcaagtcgagcgagtcncttcggnggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgaggggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 413 - DNA, 1391 bp, Brevibacillus invocatus
tcgagcgagtcccttcgggggctagcggcggacgggtgagtaacacgtaggcaacctgcccgtaagctcgggataacatggggaaactcatgctaataccggatagggtcttctctcgcatgagaggagacggaaaggtggcgcaagctaccacttacggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagagacaacaagtaccgttcgaacagggcggtaccttgcggtacctgacgagaaagccacggctaactacgtgccagcagccgcggtaatacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctacatatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggaagctagctcgcgagagtatgccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagcca

SEQ ID NO: 414 - DNA, 1470 bp, Brevibacillus laterosporus
  modified_base (231)..(231): a, c, t, g, unknown or other
gacgaacgctggcggcgtgcctaatacatgcaagtcgagcgagggtcttcggaccctagcggcggacgggtgagtaacacgtaggcaacctgcctgtaagactgggataacatagggaaacttatgctaataccggatagggttttgcttcgcctgaagcgaaacggaaagatggcgcaagctatcacttacagatgggcctgcggcgcattagctagttggtgaggtaanggctcaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgctatttaaataaggtagcaccttgacggtacctaaccagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgtgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccactgaccgctctagagatagagcttcccttcggggcagtggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacttcgcgagaagatgctaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgtaaggagccagccgccgaaggtggggtagataactggggtgaagtcgtaacaa

SEQ ID NO: 415 - DNA, 1486 bp, Brevibacillus parabrevis
cgaacgctggcggcgtgcctaatacatgcaagtcgagcgagggttttcggaccctagcggcggacgggtgagtaacacgtaggcaacctgcctctcagaccgggataacatagggaaacttatgctaataccggataggtttttggattgcatgatccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtgccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctctgaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 416 - DNA, 1486 bp, Brevibacillus reuszeri
  modified_base (994)..(994): a, c, t, g, unknown or other
cgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggaccgcatggtccgaaaagaaaagatggcttcggctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaataagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttccnttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggacgctagcccgcgagggtatgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaagg

SEQ ID NO: 417 - DNA, 1477 bp, Brevibacillus sp. phR
gatcctggctcaggacgaacgctggcggcgtgcctaatacatgcaagtcgagcgaaggacttcggtccttagcggcggacgggtgagtaacacgtaggcaacctgcccgtcagacygggataacatagggaaacttatgctaataccagataggtttctsgactgcatggtaggaraaggaaagayggcgcaagctgtcacttggggatgggcctgcggcgcattagctggttggcggggtaacggcccaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggccttcgggttgtaaagttctgttgtcagggacgaacaagtacctgttcgaacagggcggtaccttgacggtacctgacgagaaagccacggctaactacgtgccagcagccgcggtaatacgtaggtggcaagcgttgtccggaattattgggcgtaaagcgcgcgcaggcggctatgtaagtctgatgttaaagcccggggctcaactccggttcgcattggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcgataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgtcctggagacagggcttcccttcggggcagcggtgacaggtggtgcatggttgtcgtcagctcgtgtcgtgagatgttgggttaagtcccgcaacgagcgcaacccttatctttagttgccagcattcggttgggcactctagagagactgccgtcgacaagacggaggaaggcggggatgacgtcaaatcatcatgccccttatgacctgggctacacacgtgctacaatggctggtacaacgggacgcgagcccgcgagggttagccaatctctgaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtaaccgcaaggagccagccgccgaaggtggggtagatgattggggtgaagtc

SEQ ID NO: 418 - DNA, 1385 bp, Brevibacillus thermoruber
  modified_base (1374)..(1374): a, c, t, g, unknown or other
tttgaagcttgcttcagacaggttagcggcggacgggtgagtaacacgtaggcaacctgcccgcaagaccgggataacgtagggaaacttacgctaataccggatagggcaccttctcgcatgagagggtgcggaaaggtggcgcaagctaccacttgcggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgatgaaggtcttcggattgtaaagttctgttgtcagggacgaacaagtaccgttcgaacagggcggtaccttgacggtacctgacgagaaagccccggctaactacgtgccagcagccgcggtaatacgtagggggcaagcgttgtccggaattattgggcgtaaagcgcgcgcaggcggtcgggtaagtctgatgtcaaagcccggggctcaaccccggtacgcattggaaactgctcgacttgagtgcagaagaggaaagcggaattccacgtgtagcggtgaaatgcgtagagatgtggaggaacaccagtggcgaaggcggctttctggtctgtaactgcgctgaggcgcgaaagcgtggggagcaaacaggattagataccctggtagtccacgccgtaaacgatgagtgtaggtgttgggggtttcaatcctcagtgccgcagtaacgcaataagcactccgcctggggagtacgctcgcaagagtgaaactcaaaggaattgacgggggcccgcacaagcggtggagcatgtggtttaattcgaagcaacgcgaagaaccttaccggtcttgacatcccgctgaccgcctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgttacaatggttggtacaacgggacgcaagcccgcgagggtaagccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtanccgcaaggagc

SEQ ID NO: 419 - DNA, 1474 bp, Brevibacterium aurantiacum
  modified_base (10)..(10): a, c, t, g, unknown or other
  modified_base (35)..(35): a, c, t, g, unknown or other
  modified_base (418)..(419): a, c, t, g, unknown or other
  modified_base (421)..(421): a, c, t, g, unknown or other
ctgcgtgctnaacacatgcaagtcgaacgctgaanccctggtgcttgcacggggtggatgagtggcgaacgggtgagtaacacgtgagtaacctgcccccgacttcgggataagcccgggaaactgggtctaataccggatatgaccatcactcgcatgagtgatggtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagccnntnggggtgacggtacctgcagaagaagtaccggctaactacgtgccagcagccgcggtaatacgtagggtacaagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtacgtaacgcattaagtgccccgcctggggagtacggtcgcaaggctaaaactcaaaggaattgacgggggccgcacaagcggcggagcatgcggattaattcgatgcaacgcgaagaaccttaccaaggcttgacatacaccagaccgttctggaaacagttcctccctttggggttggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagatgcgagaccgcgaggttttagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggggccgtctaaggtgggactggtgattgggactaagtcgtaacaaggtagccgtaccggaaggtgc

SEQ ID NO: 420 - DNA, 1389 bp, Brevibacterium casei
tgcagtcgtacgctgaagcctgtagcttgcaccgggtggatgagtggcgaacgggtgagtaacacgtgagtaacctgcccctgacttcgggataagcccgggaaactgggtctaataccggatacgactgccggacgcatgtctggtggtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcgcaagtgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtggggggcattccacgttctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatacaccggaccgtcctggaaacaggtcctcttctttgaagctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagaggcgaacccgtgagggcaagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcctaaccgtaaggaggggg

SEQ ID NO: 421 - DNA, 1480 bp, Brevibacterium epidermidis
  modified_base (162)..(162): a, c, t, g, unknown or other
ctgcgtgcttaacacatgcaagtcgaacgctgaagccgacagcttgctgttggtggatgagtggcgaacgggtgagtaacacgtgagtaacctgcccctgatttcgggataagcctgggaaactgggtctaataccggatacgaccacctgacgcatgttgngtggtggaaagtttttcgatcggggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcgaaagtgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtacgtaacgcattaagtgccccgcctggggagtacggtcgcaaggctaaaactcaaaggaattgacgggggccgcacaagcggcggagcatgcggattaattcgatgcaacgcgaagaaccttaccaaggcttgacatacactggaccgttctggaaacagttcttctctttggagctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagaggcgaacccgtgagggtaagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtgtcccaacccttttgggagggggccgtctaaggtgggactggtgattgggactaagtcgtaacaaggtagccgtaccggaaggtgcgctggatcacct

SEQ ID NO: 422 - DNA, 1540 bp, Brevibacterium frigoritolerans
gtttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctt

SEQ ID NO: 423 - DNA, 1515 bp, Brevibacterium linens
tcaggacgaacgctggctgcgtgcttaacacatgcaagtcgaacgctgaagccctggtgcttgcaccggggtggatgagtggcgaacgggtgagtaacacgtgagtaacctgcccccgacttcgggataagcccgggaaactgggtctaataccggatatgacsaysrmtsgcatswktgrtkgtggaaagttttttcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcctttcggggtgacggtacctgcagaagaagtaccggctaactacgtgccagcagccgcggtaatacgtagggtacaagcgttgtccggaattattgggcgtaaagagctcgtaggtggttggtcacgtctgctgtggaaacgcaacgcttaacgttgcgcgtgcagtgggtacgggcttgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgactatacaccagaccgttctggaaacagttcctcccctttggggttggtgtacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccctttatgtcttgggcttcacgcatgctacaatggctggtacagagagatgcgagaccgcgaggttttagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggggccgtctaaggtgggactggtgattgggactaagtcgtaacaaggtagccgtaccggaaggtgcggctggatcacctcctttct

SEQ ID NO: 424 - DNA, 1527 bp, Brevibacterium mcbrellneri
tttttgtggagagtttgatcctggctcaggacgaacgctggcggcgtgcttaacacatgcaagtcgaacgctgaagcttggtgttttcactgggtggatgagtggcgaacgggtgagtaacacgtgagtaacctgccctttacttcgggataagcttgggaaactgggtctaataccggatattctgcgtgatcgtatggttgtgtaggaaagattttttggtaagggatgggctcgcggcctatcagtttgttggtggggtgatggcctaccaagacgacgacgggtagccggcctgagagggcgaccggccacactgggactgagacacggcccagactcctacgggaggcagcagtggggaatattgcacaatgggggaaaccctgatgcagcgacgccgcgtgggggatgacggccttcgggttgtaaacctctttcagtagggaagaagcgtaagtgacggtacctgcagaagaagtaccggctaactacgtgccagcagccgcggtaatacgtagggtactagcgttgtccggaattattgggcgtaaagagctcgtaggtggtttgtcgcgtctgctgtggaaacgtgccgcttaacggtgcgcgtgcagtgggtacgggcggactagagtgcagtaggggagtctggaattcctggtgtagcggtgaaatgcgcagatatcaggaggaacaccggtggcgaaggcgggactctgggctgttactgacgctgaggagcgaaagcatggggagcgaacaggattagataccctggtagtccatgccgtaaacgttgggcactaggtgtggggtccattccacggattctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggatcgctgcagagatgtggttttctttttgactggtgtacaggtggtgcatggttgtcgtcagctcgtgtcgtgagatgttgggttaagtcccgcaacgagcgcaaccctcgttctatgttgccagcacgtgatggtgggaactcatgggagactgccggggtcaactcggaggaaggtggggatgacgtcaaatcatcatgccctttatgtcttgggcttcacgcatgctacaatggccggtacagagggtggcgataccgtgaggtggagcgaatctcttaaagccggtctcagttcggatcgtagtctgcaactcgactacgtgaagtcggagtcgctagtaatcgcagatcagcaatgctgcggtgaatacgttcccgggccttgtacacaccgcccgtcaagtcacgaaagtcggtaacacccgaagccggtggcctaaccttttggggggagccgtcgaaggtgggactggtgattgggactaagtcgtaacaaggtagccgtaccggaaggtgcggctggatcacctcctttct

SEQ ID NO: 425 - DNA, 1441 bp, Brevibacterium paucivorans
gaagctggcggcgtgcttaacacatgcaagtcgaacgatgaagctctagcttgctggggtggattagtggcgaacgggtgagtaacacgtgagtaacctgccctttacttcgggataagcttgggaaactgggtctaataccggatattctgcatggtcggatggttgtgtaggaaagattttttggtaagggatgggctcgcggcctatcagtttgttggtggggtgatggcctaccaagacgacgacgggtagccggcctgagagggcgaccggccacactgggactgagacacggcccagactcctacgggaggcagcagtggggaatattgcacaatgggggaaaccctgatgcagcgacgccgcgtgggggatgacggccttcgggttgtaaacctctttcagtagggaagaagcgaaagtgacggtacctgcagaagaagtaccggctaactacgtgccagcagccgcggtaatacgtagggtactagcgttgtccggaattattgggcgtaaagagctcgtaggtggtttgtcgcgtctgctgtggaaacgtgccgcttaacggtgcgcgtgcagtgggtacgggcggactagagtgcagtaggggagtctggaattcctggtgtagcggtgaaatgcgcagatatcaggaggaacaccggtggcgaaggcgggactctgggctgttactgacgctgaggagcgaaagcatggggagcgaacaggattagataccctggtagtccatgccgtaaacgttgggcactaggtgtggggtccattccacggattctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactagaccatcgcagagatgtggttttctttttgactggtgtacaggtggtgcatggttgtcgtcagctcgtgtcgtgagatgttgggttaagtcccgcaacgagcgcaaccctcgttctatgttgccagcacgtgatggtgggaactcatgggagactgccggggtcaactcggaggaaggtggggatgacgtcaaatcatcatgccctttatgtcttgggcttcacgcatgctacaatggccggtacagagggtggcgataccgtgaggtggagcgaatctcttaaagccggtctcagttcggatcgtagtctgcaactcgactacgtgaagtcggagtcgctagtaatcgcagatcagcaatgctgcggtgaatacgttcccgggccttgtacacaccgcccgtcaagtcacgaaagtcggtaacacccgaagccggtggcctaaccctgtgtggggggagccgtcgaaggtgggactggtgattgggact

SEQ ID NO: 426 - DNA, 1341 bp, Brevibacterium sanguinis
gagtttgatcctggctcaggacgaacgctggctgcgtgcttaacacatgcaagtcgaacgagtggcgaacgggtgagtaacacgtgagtaacctgcccctgacttcgggataagcccgggaaactgggtctaataccggatacggaaagtcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagatgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgactgacactgaggagcgaaagcatggggagcgaacaggattagataccctggtagtccatgccgtaaacgttgggcactaggtgtgggggtctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatatacaggtggtgcatgttgtcgtcagctcgtgtcgtgagatgttgggttaagtcccgcaacgagcgcaaccctcgttctatgttgccagcacgtgggaactcataggagactgccggggtcaactcggaggaaggtggggatgacgtcaaatcatcatgccctttatgtcttgggcttcacgcatgctacaatggctggcaaagagaagcgaacccgtgagggtcagcgaatcccttccagtctcagttcggacgtagtctgcaattcgactacggaagtcggagtcgctagtaatcgcagatcagcaacgctgcggtgaatacgttcccgggccttgtacacaccgcccgtcaagtcacgaaagtcggtaacacccgaagccggtgcctagggggccgtctaaggtgggactggtgattgggactaagtcgtaacaaggtagccgtaccg

SEQ ID NO: 427 - DNA, 1367 bp, Brevibacterium sp. H15
gagtttgatcctggctcaggacgaacgctggctgcgtgcttaacacatgcaagtcgaacgagtggcgaacgggtgagtaacacgtgagtaacctgcccctgacttcgggataagcccgggaaactgggtctaataccggatacggaaagtcggttggggatgggctcgcggcctatcagtttgttggtgaggtaatggctcaccaagacgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagatgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgactgacactgaggagcgaaagcatggggagcgaacaggattagataccctggtagtccatgccgtaaacgttgggcactaggtgtgggggtctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatatacaggtggtgcatggttgtcgtcagctcgtgtcgtgagatgttgggttaagtcccgcaacgagcgcaaccctcgttctatgttgccagcacgtgggaactcataggagactgccggggtcaactcggaggaaggtggggatgacgtcaaatcatcatgccctttatgtcttgggcttcacgcatgctacaatggctggcagagagaggcgaacccgtgagggcaagcgaatcccttccagtctcagttcggacgtagtctgcaattcgactacggaagtcggagtcgctagtaatcgcagatcagcaacgctgcggtgaatacgttcccgggccttgtacacaccgcccgtcaagtcacgaaagtcggtaacacccgaagccggtgcctagggggccgtctaatgtgggactggtgattgggactaattcgtaacaaggtagccgtaccggaaggtgcggctggatcacctcctt

SEQ ID NO: 428 - DNA, 1491 bp, Brevibacterium sp. JC43
tagagtttgatcctggctcaggacgaacgctggcggcgtgcttaacacatgcaagtcgaacgatgaagctcctgcttgcaggagtggattagtggcgaacgggtgagtaacacgtgagtaacctgcccctgactgcgggataagcccgggaaactgggtctaataccgcatatgacacctggccgcatggtctgggtgtggaaagtttttcggttggggatgggctcgcggcctatcagcttgttggtggggtaacggcctaccaaggcgacgacgggtagccggcctgagagggcgaccggccacactgggactgagacacggcccagactcctacgggaggcagcagtggggaatattgcacaatgggggaaaccctgatgcagcgacgccgcgtgagggatgacggccttcgggttgtaaacctctttcagtagggaagaagccttcgggtgacggtacctgcagaagaagtaccggctaactacgtgccagcagccgcggtaatacgtagggtacaagcgttgtccggaattattgggcgtaaagagctcgtaggcggttcgtcgcgtctgctgtggaaacgcaaggctcaaccttgcgcgtgcagtgggtacgggcggactagagtgcagtaggggagtctggaattcctggtgtagcggtgaaatgcgcagatatcaggaggaacaccggtggcgaaggcgggactctgggctgtaactgacgctgaggagcgaaagcatggggagcgaacaggattagataccctggtagtccatgccgtaaacgttgggcactaggtgtggggctcattccacgagttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactggaatgtgccagagatggttcagcccttttgggctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggtcggtacaaagggttgcgatgccgtgaggtggagcgaatcccagaaagccgatctcagttcggatcgtagtctgcaactcgactacgtgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggtgattgggactaagtcgtaacaaggtagccgta

SEQ ID NO: 429 - DNA, 1449 bp, Brevundimonas subvibrioides
agagtttgatcctggctcagagcgaacgctggcggcaggcctaacacatgcaagtcgaacggacctctcggggttagtggcggacgggtgagtaacacgtgggaacgtgccttttggttcggaatagctcctggaaacgggtggtaatgccgaatgtgccctttgggggaaagatttatcgccattagagcggcccgcgtctgattagctagttggtgaggtaaaggctcaccaaggctacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgtttacatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacct

SEQ ID NO: 430 - DNA, 1493 bp, Brucella abortus
aacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 431 - DNA, 981 bp, Brucella canis
tgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatgcctatgaatgttagtggagacactttcagcctttcggggcgtaggacacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcag

SEQ ID NO: 432 - DNA, 1485 bp, Brucella ceti
caacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctccttt

SEQ ID NO: 433 - DNA, 1500 bp, Brucella melitensis
aattttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 434 - DNA, 1390 bp, Brucella microti
caggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactgggg

SEQ ID NO: 435 - DNA, 1489 bp, Brucella ovis
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttct

SEQ ID NO: 436 - DNA, 1489 bp, Brucella sp. 83/13
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcttacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggtaggcgaccacggtagggtcagcgactggggtgaagtcgtaacaaggtagccgtaggggaacctgcggctggatcacctcctttct

SEQ ID NO: 437 - DNA, 1412 bp, Brucella sp. BO1
ctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtg

SEQ ID NO: 438 - DNA, 1493 bp, Brucella suis
aacttgagagtttgatcctggctcagaacgaacgctggcggcaggcttaacacatgcaagtcgagcgctccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcagctggatcacctcctttctaaggaag

SEQ ID NO: 439 - DNA, 1535 bp, Bryantella formatexigens
ttttatttgagagtttgatcctggctcaggatgaacgctggcggcgtgcttaacacatgcaagtcgagcgaagcattttaaatgaagttttcggacggaatttaaaatgactgagcggcggacgggtgagtaacgcgtggataacctgccttatacagggggataacagccagaaatggctgctaataccgcataagcgcacggtaccgcatggtacagtgtgaaaaactccggtggtataagatgggtccgcgttggattaggcagttggcggggtaaaggcccaccaaaccgacgatccatagccggcctgagagggtggacggccacattgggactgagacacggcccagactcctacgggaggcagcagtggggaatattgcacaatgggggaaaccctgatgcagcgacgccgcgtgggtgaagaagtatttcggtatgtaaagccctatcagcagggaagaaaatgacggtacctgaccaagaagccccggctaactacgtgccagcagccgcggtaatacgtagggggcaagcgttatccggatttactgggtgtaaagggagcgtagacggccatgcaagtctggtgtgaaaggcgggggctcaacccccggactgcattggaaactgtatggcttgagtgccggagaggtaagcggaattcctggtgtagcggtgaaatgcgtagatatcaggaggaacaccagtggcgaaggcggcttactggacggtaactgacgttgaggctcgaaagcgtggggagcaaacaggattagataccctggtagtccacgccgtaaacgatgaataccaggtgtcgggggacacggtccttcggtgccgcagcaaacgcactaagtattccacctggggagtacgttcgcaagaatgaaactcaaaggaattgacggggacccgcacaagcggtggagcatgtggtttaattcgaagcaacgcgaagaaccttaccaggtcttgacatccggacgaccggacagtaacgtgtccttcccttcggggcgtccgagacaggtggtgcatggttgtcgtcagctcgtgtcgtgagatgttgggttaagtcccgcaacgagcgcaacccctgttcccagtagccagcattcaggatgggcactctggggagactgccagggataacctggaggaaggcggggatgacgtcaaatcatcatgccccttatgatctgggctacacacgtgctacaatggcgtgaacagagggaagcgaacccgcgagggggagcaaatcccagaaataacgtcccagttcggattgtagtctgcaacccggctacatgaagctggaatcgctagtaatcgcggatcagcatgccgcggtgaatacgttcccgggtcttgtacacaccgcccgtcacaccatgggagtcggaaatgcccgaagtcagtgacccaaccggaaggagggagctgccgaaggcggggccggtaactggggtgaagtcgtaacaaggtagccgtatcggaaggtgcggctggatcacctcctttct

SEQ ID NO: 440 - DNA, 1519 bp, Buchnera aphidicola
agagtttgatcatggctcagattgaacgctggcggcaagcttaacacatgcaagtcgagcggcatcgaagaaaagtttacttttctggcggcgagcggcaaacgggtgagtaacatctggggatctacctaaaagagggggacaaccattggaaacgatggctaataccgcataatgtttttaaataaaccaaagtaggggactaaaatttttagccttatgcttttagatgaacccagacgagattagcttgatggtaaggtaatggcttaccaaggcgacgatctctagctggtctgagaggataaccagccacactggaactgagatacggtccagactcctacgggaggcagcagtggggaatattgcacaatgggctaaagcctgatgcagctatgccgcgtgtatgaagaaggccttagggttgtaaagtactttcagcggggaggaaagaattatgtctaatatacatattttgtgacgttacccgaagaagaagcaccggctaactccgtgccagcagccgcggtaatacggagggtgcgagcgttaatcagaattactgggcgtaaagagcacgtaggcggtttattaagtcagatgtgaaatccctaggcttaacttaggaactgcatttgaaactaatagactagagtctcatagagggaggtagaattctaggtgtagcggtgaaatgcgtagatatctagaggaatacccgtggcgaaagcgacctcctaaatgaaaactgacgctgaggtgcgaaagcgtggggagcaaacaggattagataccctggtagtccatgctgtaaacgatgtcgacttggaggttgtttcctagagaagtggcttccgaagctaacgcattaagtcgaccgcctggggagtacggtcgcaaggctaaaactcaaatgaattgacgggggcccgcacaagcggtggagcatgtggtttaattcgatgcaacgcgaagaaccttacctggtcttgacatccatagaattttttagagataaaagagtgccttagggaactatgagacaggtgctgcatggctgtcgtcagctcgtgttgtgaaatgttgggttaagtcccgcaacgagcgcaacccctatcctttgttgccatcaggttatgctgggaactcagaggagactgccggttataaaccggaggaaggtggggatgacgtcaagtcatcatggcccttacgaccagggctacacacgtgctacaatggcatatacaaagagatgcaactctgcgaagataagcaaacctcataaagtatgtcgtagtccggactggagtctgcaactcgactccacgaagtaggaatcgctagtaatcgtggatcagaatgccacggtgaatacgttcccgggccttgtacacaccgcccgtcacaccatgggagtgggttgcaaaagaagcaggtagcttaaccagattattttattggagggcgcttaccactttgtgattcatgactggggtgaagtcgtaacaaggta

SEQ ID NO: 441 - DNA, 1528 bp, Bulleidia extructa
tcaaatgaagagtttgatcctggctcaggataaacgctggcggcgtgcctaatacatgcaagtcgaacgccggacacctagcttgctagggagaaggagtggcgaacgggtgagtaatacataagcaatctgcccacaaagactgggataacctctggaaacggggactaataccggataggtaggagagaggcatctttcttctattaaagatgagaagcactagtggatgagcttatggcgcattagttagttggtgaggtaacggcccaccaagacgatgatgcgtagccggcctgagagggtgaacggccacattgggactgagacacggcccagactcctacgggaggcagcagtagggaattttcggcaatggggggaaccctgaccgagcaacgccgcgtgagtgaagacggccttcgggttgtaaagctctgttgtaagaaaagataaactaggagaggatcttagtcagacattatcttaccagaaagccacggctaactacgtgccagcagccgcggtaatacgtaggtggcgagcgttatccggaattattgggcgtaaagggtgcgtaggcggtctgttaagttcatggtcaaattgtggggctcaaccccatcgcgccatggatactggcagactagagtattggagaggcaagtggaattccatgtgtagcggtaaaatgcgtagatatatggaggaacaccggtggcgaaggcgacttgctagccaaagactgacgctgaggcacgaaagcgtggggagcaaataggattagataccctagtagtccacgctgtaaacgatgaatactaagtattggggagactcagtgctgcagctaacgcattaagtattccgcctgtggagtatgcacgcaagtgtgaaacataaaggaattgacgggggcccgcacaagcggtggagtatgtggtttaattcgacgcaacgcgaagaaccttaccaggccttgacatcccttgcgaagttctagagataggatagaggttatcaaggagacaggtggtgcatggttgtcgtcagctcgtgtcgtgagatgttgggttaagtcccgcaacgagcgcaacccttgtcttcagttaccatcattaagttggggactctggagagactgccggtgataaaccggaggaaggtggggatgacgtcaaatcatcatgccccttatggcctgggctacacacgtactacaatggctattacaacgtggagcgactgtgcgaacagaagcgaatcactgaaagatagtctcagttcggattggagtctgcaactcgactccatgaagttggaatcgctagtaatcgcggatcagcatgccgcggtgaatacgttctcgggccttgtacacaccgcccgtcataccatgagagttggtaatacccgaagccggtggcctaaccgaaaggaaggagccgtcgaaggtaggactaatgattggggtcaagtcgtaacaaggtatccctacgagaacgtggggatggatcacctcctttct

SEQ ID NO: 442 - DNA, 1537 bp, Burkholderia ambifaria
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 443 - DNA, 1537 bp, Burkholderia cenocepacia
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 444 - DNA, 1494 bp, Burkholderia cepacia
agtttgatcctggctcagattgaacgctagcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgttccagcaatgccgcgtgtgtgaagaaggccttcgggttgtaaagcacttttgtccggaaagaaatccttggttctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaaccaa

SEQ ID NO: 445 - DNA, 1538 bp, Burkholderia mallei
tgaactgaagagtttgatcctggctcagattgaacgctggcggcatgccttacacatgcaagtcgaacggcagcacgggcttcggcctggtggcgagtggtgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgag

SEQ ID NO: 446 - DNA, 1537 bp, Burkholderia multivorans
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatacgatcgggggatgacggtaccggaagaataagcaccggctaactacgtgccagcagccgcggtaatacgtagggtgcgagcgttaatcggaattactgggcgtaaagcgtgcgcaggcggtctgttaagacagatgtgaaatccccgggctcaacctgggaactgcatttgtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagattcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttcc

SEQ ID NO: 447 - DNA, 1499 bp, Burkholderia oklahomensis
agattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctaccgactaatactgggtggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatc

SEQ ID NO: 448 - DNA, 1538 bp, Burkholderia pseudomallei
tgaactgaagagtttgatcctggctcagattgaacgctggcggcatgccttacacatgcaagtcgaacggcagcacgggcttcggcctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgag

SEQ ID NO: 449 - DNA, 1474 bp, Burkholderia rhizoxinica
gttgatcctggctcagattgaacgctggcggcatgccttacacatgcaagtcggacggcagcgcgggtttcggcctggcggcgagtggcgaacgggtgagtaagacatcggaacgtgtcctggagtgggggatagcccggcgaaagccggattaataccgcatacgctctgaggaggaaagcgggggaccttagggcctcgcgctcaaggggcggccgatggcagattagctagttggtagggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacggcctggctaatacctgggctggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggcttaacctgggaactgcattggtgactggcaggctagagtatggcagagggaggtagaattccacgtgtagcagtgaaatgcgtagagatgtggaggaataccgatggcgaaggcagcctcctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgagaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcagtctgcaactcgactgcatgaagctggaatcgctagtaatcgcggatcagcatgtcgcggtgaatacgttcccgggtcttgtacacaccgcccgtcacaccatgggagtgggttttaccagaagtggctagtctaaccgcaaggaggacggtcaccacggtaggattcatgactggggtgaagtc

SEQ ID NO: 450 - DNA, 1537 bp, Burkholderia sp. 383
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggccctaatacggtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaattccgctgagaggtggaagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttct

SEQ ID NO: 451 - DNA, 1462 bp, Burkholderia xenovorans
gaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctgcggaggaaagcgggggatcttcggacctcgcgctacaggggcggccgatggcagattagctggttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctctgccctaatacggtggggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaagtctgctgagaggtggatgtgcccgaaagggagccataacacaggtgctgcatggctgtcgacagctcgtgtcgtgagatgttgggttaagtcccgcaacgagcgcaccccttgtccctagttgctacgcaagagcactccagggagactgccggtgacaacccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgggtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactgggtgaagtcgtaacaag

SEQ ID NO: 452 - DNA, 1543 bp, Burkholderiales bacterium 1_1_47
ttaaacaatagagtttgatcctggctcagattgaacgctggcggaacgctttacacatgcaagtcgaacggtaacgcgggagaagcttgcttctcccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttcgaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggaagtaaaattctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagtgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagtcgtgagacggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgactaatgttaagtcgtaacaaggtagccgtaccggaaggtgcggctggatcacctcctttc

SEQ ID NO: 453 - DNA, 1481 bp, Butyricicoccus pullicaecorum
agtttgatcctggctcaggatgaacgctggcggcgtgcctaacacatgcaagtcgaacggagttgtttgaggaaatccttcgggatggaatcttccaacttagtggcggacgggtgagtaacgcgtgagcaatctgcctttcagagggggataacagccggaaacggctgctaataccgcataatgcattgaattcgcatgtttttgatgccaaagattttatcgctgaaagatgagctcgcgtctgattagctagttggcggggtaacggcccaccaaggcgacgatcagtagccggactgagaggttgaacggccacattgggactgaggacacggcccagactcctaccgggaggcagcagtggggaatattgcgcaatgggggcaaccctgacgcagcaacgccgcgtgattgatgaaggtcttcggattgtaaaaatctttaatcagggacgaaacaaatgacggtacctgaagaataagctccggctaactacgtgccagcagccgcggtaatacgtagggagcaagcgttatccggatttactgggtgtaaagggcgtgtaggcgggcttgtaagttggaagtgaaatctcggggcttaaccccgaaactgctttcaaaactgcgagtcttgagtgatggagaggcaggcggaattcccagtgtagcggtgaaatgcgtagatattgggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccggagttaacacaataagtatcccacctggggagtacggccgcaaggttgaaactcaaaggaattgacgggggcccgcacaagcagtggagtatgtggtttaattcgaagcaacgcgcaagaaccttaccaagtcttgacatcccgatgaccgctcyagagatagggcttttcttcggaacatcggtgacaggtggtgcatggttgtcgtcagctcgtgtcgtgagatgttgggttaagtcccgcaacgagcgcaacccttacgggttagttgctacgcaagagcactctagccggactgccgttgacaaaacggaggaaggtggggacgacgtcaaatcatcatgccccttatgacttgggctacacacgtactacaatggcagtcatacagagggaagcaaaaccgcgaggtggagcaaatccctaaaagctgtcccagttcagattgcaggctgcaactcgcctgcatgaagtcggaattgctagtaatcgcggatcagcatgccgcggtgaatacgttcccgggccttgtacacaccgcccgtcacaccatgagagccggtaatacccgaagtccgtagtctaaccgcaaggaggacgcggccgaaggtaggactggtaattgggacgaagtcgt

SEQ ID NO: 454 - DNA, 1379 bp, Butyricimonas virosa
  modified_base (14)..(14): a, c, t, g, unknown or other
ggggcagcgcgggnagtagcaatactctcgccggcgaccggcgcacgggtgagtaacacgtgtgcaaccaaccccgtaccgggagataacccgcggaaacgtggactaacatcccataagactctagagccgcatggctctggatttaaaattccggtggtacgggacgggcacgcgcgacattaggtagttggcggggtaacggcccaccaagccgacgatgtctaggggttctgagaggaaggtcccccacactggaactgagacacggtccagactcctacgggaggcagcagtgaggaatattggtcaatgggcgagagcctgaaccagccaagtcgcgtgagggaagaatggtctatggcctgtaaacctcttttgtcaaggaagaataaaaggtacgtgtaccttcttgccagtacttgacgaataagcatcggctaactccgtgccagcagccgcggtaatacgggggatgcgagcgttatccggatttattgggtttaaagggcgcgtaggcgggacccaagtcagcggtaaaagactgcagctaaactgtagcacgccgttgaaactggcgacctcgagacgagacgagggaggcggaacaagtgaagtagcggtgaaatgcttagatatcacttggaaccccgatagcgaaggcagcttcccaggctcgatctgacgtgatgcgcgagagcgtgggtagcgaacaggattagataccctggtagtccacgccgtaaacgatgctcactggatcttggcgatacactgccagggttcaagcgaaagtattaagtgagccacctggggagtacgtcggcaacgatgaaactcaaaggaattgacgggggcccgcacaagcggaggaacatgtggtttaattcgatgatacgcgaggaaccttacccgggtttaaatgtattttgcatttcttggaaacaggaattcccttcggggctagatacaaggtgctgcatggttgtcgtcagctcgtgccgtgaggtgtcgggttaagtcccataacgagcgcaacccctatcgccagttgccagcggctgaggccgggcactctgtcgagactgccaccgtaaggtgcgaggaaggcggggatgacgtcaaatcagcacggcccttacacccggggcgacacacgtgttacaatggccggtacagagggcagccacggggtgacccggagcgaatctctaaagccggtcgtagttcggactggagtctgcaacccgactccacgaagttggattcgctagtaatcgcgcatcagccatggcgcggtgaatacgttcccgggccttgtacacaccgcccgtcaagccatggaagccgggagtacctgaagatcgtgaccgcgagga

SEQ ID NO: 455 - DNA, 1526 bp, Butyrivibrio crossotus
tttatatgagagtttgatcctggctcaggatgaacgctggcggcgtgcttaacacatgcaagtcgaacgaagcacttcataaagcttgctttaagaagtgacttagtggcggacgggtgagtaacgcgtgggtaacctgccttacacagggggataacagttagaaatgactgctaataccgcataaaacagcagagtcgcatgactcaactgtcaaagatttatcggtgtaagatggacccgcgtctgattagcttgttggtggggtaacggcctaccaaggcgacgatcagtagccggcctgagagggtgaacggccacattgggactgagacacggcccaaactcctacgggaggcagcagtggggaatattggacaatgggcgaaagcctgatccagcgacgccgcgtgagcgatgaagtatttcggtatgtaaagctctatcagcagggaagaaaacgacggtacctgactaagaagccccggctaactacgtgccagcagccgcggtaatacgtagggggcaagcgttatccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttgggtttcataagaagctcggtgccggcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgttgacctgttatgtaatgtaacatctcttcggagcaacggagacaggtggtgcatggttgtcgtcagctcgtgtcgtgagatgttgggttaagtcccgcaacgagcgcaacccttgtccttagtagccagcagtaagatgggcactctagggagactgccggggataactcggaggaaggtggggacgacgtcaaatcatcatgccccttatgacttgggctacacacgtgctacaatggcgtaaacaaagggaagcgaacctgtgaaggcaagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgtaaatgcccgaagtcggtgacctaaccgtaaggaaggagccgccgaaggcaggtatgataactggggtgaagtcgtaacaaggtagccgtatcggaaggtgcggctggatcacctcctttct

SEQ ID NO: 456 - DNA, 1477 bp, Butyrivibrio fibrisolvens
tggcggcgtgcctaacacatgcaagtcgaacggagttattcgctgatgaagcttcggcagaatcttgaataacttagtggcggacgggtgagtaacgcgtgggtaacctgcctcatacagggggatagcagttggaaacgactgataacaccgcataagcgcacagtgtcgcatgacacagtgtgaaaatatttataggtatgagatggacccgcgtctgattagctagttggtgaggtaacggcccaccaaggcgacgatcagtagccggcctgagagggcggacggccacattgggactgagacacggcccaaactcctacgggaggcagcagtgggggatattgcacaatgggcgaaagcctgatgcagcgacgccgcgtgagtgaagaagtatttcggtatgtaaagctctatcagcagggaagaaagacctcgtaagaggggatgacggtacctgagtaagaagccccggctaactacgtgccagcagccgcggtaatacgtagggggcaagcgttatccggatttactgggtgtaaagggagcgtagacggtgtatcaagtctgaagtgaaaccccacggctcaaccgtgggcttgctttggaaactggtagactagagtactggagaggtaagcggaattcctggtgtagtagtgaaatgcgtagatatcaggaagaacatcagtggcgaaggcggcttactggacagcaactgacgttgaggctcgaaagcgtggggagcaaacaggattagataccctggtagtccacgccgtaaacgatgaatactaggtgttgggagacatagtctttcagtgccggcgctaacgcaataagtattccacctggggagtacgttcgcaagaatgaaactcaaaggaattgacggggacccgcacaagcggtggagcatgtggtttaattcgaagcaacgcgaagaaccttaccaaatcttgagatccagatgaatgatgggtaatgccatcagtccttcgggacatctgagacaggtggtgcatggttgtcgtcagctcgtgtcgtgagatgttgggtcaagtcccgcaacgagcgcaacccttgtccatagtagccagcagtaagatgggcactctatggagactgccagggataacctggaggaaggtggggatgacgtcaaatcatcatgccccttatgatttgggccacacacgtgctacaatgtcgtaacaaagggaagcaaccctgcgaaggtgagcaaatcccaaaaataacgacccagttcggactgtaggctgcaacccgcctgcacgaagctggaatcgctagtaatcgcagatcagaatgctgcggtgaatacgttcccgggtcttgtacacaccgcccgtcacaccatgggagtcggaaatgcccaaagtcagtggcctaaccgtaaggagggagcttgctaaggcaggtcggataactggggtgaagtcgtaacaaggtagcc

SEQ ID NO: 457 - DNA, 1466 bp, Caldimonas manganoxidans
attgaacgctggcggcatgctttacacatgcaagtcgaacggcagcgggtccttcgggatgccggcgagtggcgaacgggtgagtaatgcatcggaacgtacccagtcgtgggggataactactcgaaagagtagctaataccgcatacgacctgagggtgaaagcgggggaccgcaaggcctcgcgcgattggagcggccgatgtcggattagctagttggtggggtaaaggcttaccaaggcgacgatccgtagctggtctgagaggacggccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaaagctctgggctaatacctcggagtgatgacggtacctgaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaactgcatttgtgactgcacggctagagtgcggcagagggggatggaattccgcgtgtagcagtgaaatgcgtagatatgcggaggaacaccgatggcgaaggcagtcccctgggcctgcactgacgctcatgcacgaaagcgtggggagcaaacaggattagataccctggtagtccacgccctaaacgatgtcaactggttgttggggattcatttcctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaaccctgcagagatgtgggggtgctcgaaagagagcctggacacaggtgctgcatggccgtcgtcagctcgtgtcgtgagatgttgggttaagtcccgcaacgagcgcaacccttgccattagttgctacgaaagggcactctaatgggactgccggtgacaaaccggaggaaggtggggatgacgtcaggtcctcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagcgggttctgccagaagtgggtagcctaaccgcaaggagggcgcttaccacggcagggttcgtgactggggtgaagtcgtaacaag

SEQ ID NO: 458 - DNA, 1456 bp, Caminicella sporogenes
tgatcatggctcaggatgaacgctggcggcgtgcctaacacatgcaagtcgagcggagctttaatcttttcagcttagctgaaaagattaaagcttagcggcggacgggtgagtaacgcgtgggcaacctgccctgtgcagggggataacacatcgaaaggtgtgctaataccccataagactacgatgtcgcatggcatagtagtaaaagctgaggcggcacaggatgggcccgcgtctgattagctagttggtagggtaacggcctaccaaggcaacgatcagtagccgacctgagagggtgaacggccacactggaactgagacacggtccagactcctacgggaggcagcagtggggaatattgcacaatgggggaaaccctgatgcagcaacgccgcgtgagcgaagaaggccttcgggtcgtaaagctctgtcctaagggaagaaagatgacggtaccttaggaggaagccccggctaactacgtgccagcagccgcggtaaaacgtagggggcgagcgttatccggaatgactgggcgtaaagggtgtgtaggcggccggtaaagtctggggtgaaaggctacggcttaaccgtagtaagccttggaaacttatcggcttgagtgcaggagaggagagcggaattcctagtgtagcggtgaaatgcgtagatattaggaggaacaccagtggcgaaggcggctctctggactgcaactgacgctgaggcacgaaagcgtggggagcgaacaggattagataccctggtagtccacgccgtaaacgatgagtgctaggtgttggaggttcatactttcagtgccgcagttaacgcattaagcactccgcctggggagtacggtcgcaagactgaaactcaaaggaattgacggggacccgcacaagcagcggagcatgtggtttaattcgaagcaacgcgaagaaccttaccaggacttgacatccctgtgacagcttcttaatcgaagccttcccttcggggacacaggagacaggtggtgcatggttgtcgtcagctcgtgtcgtgagatgttgggttaagtcccgcaacgagcgcaacccttgtctttagttgccagcacttagggtgggcactctaaagagactgccggtgataaaccggaggaaggtgggggatgacgtcaaatcatcatgccccttatgttctgggctacacacgtgctacaatggctggtacaaagggaagcgaaggagtaatccggagcgaatcccaaaaagccagtcccagttcggattgtgggctgcaactcgcccacatgaagccggagttgctagtaatcgcgaatcagaatgtcgcggtgaatacgttcccgggtcttgtacacaccgcccgtcacaccatgggagcccatggcacccgaagtcagtgagtcaaccgtaaaggagacagctgccgaaggtgaaatgg

SEQ ID NO: 459 - DNA, 1517 bp, Campylobacter coli
tttttatggagagtttgatcctggctcagagtgaacgctggcggcgtgcctaatacatgcaagtcgaacgatgaagcttctagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaggatacgcgaagaaccttacctgggcttgatatcctaagaaccttttagagataagagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttct

SEQ ID NO: 460 - DNA, 1458 bp, Campylobacter concisus
aatatggagagtttgatcctggctcagagtgaacgctggcggcgtgcctaatacatgcaagtcgaacggacaagtaagagcttgctcttatgagttagtggcgcacgggtgagtaatgtatagctaatctgccctacactagaggacaacagttggaaacgactgctaatactctatactcctgtcttacataagttagatagggaaagtttttcggtgtaggatgaggctatattgtatcagctagttggtgaggtaatggctcaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaacaatgacggtacctaacgaataagcaccggctaactccgtgccagcagccgcggtaatacggagggtgcaagcgttactcggaatcactgggcgtaaaggacgcgtaggcggattatcaagtctcttgtgaaatcctatggcttaaccatagaactgcttgggaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacagttcggctgagcactctaatgagactgccttcgtaaggaggaggaaggtgtggacgacgtcaagtcatcatggcccttatgtccggggcgacacacgtgctacaatggcatatacaatgagaagcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagccggaatactaaattagttaccgtccacagtggaatcagcgactgggg

SEQ ID NO: 461 - DNA, 1355 bp, Campylobacter curvus
gtctgcgaagtcgtaatatttaattgcgaagcaagtaaatattacatagggtttctcgctatgggatgaggctatatcgtatcagctagttggtagggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttggggaagaaatttgacggtacccaaggaataagcaccggctaactccgtgccagcagccgcggtaatacggagggtgcaagcgttactcggaatcactgggcgtaaaggacgcgtaggcggattatcaagtctcttgtgaaatccaatggcttaaccattgaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 462 - DNA, 1521 bp, Campylobacter fetus
tttttatggagagtttgatcctggctcagagtgaacgctggcggcgtgcctaatacatgcaagtcgaacggagtattaagagagcttgctcttttaatacttagtggcgcacgggtgagtaatgtatagttaatctgccctacactggaggacaacagttagaaatgactgctaatactccatactccttcttaacataagttaagtcgggaaagtttttcggtgtaggatgagactatattgtatcagctagttggtaaggtaatggcttaccaaggctttgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaaccatgacggtacctaacgaataagcaccggctaactccgtgccagcagccgcggtaatacggagggtgcaagcgttactcggaatcactgggcgtaaaggacgcgtaggcggattatcaagtcttttgtgaaatctaacagcttaactgttaaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctgtgctagtcacggcagtaatgcacctaacggattaagtataccgcctggggagtacggtcgcaagattaaaactcaaaggaatagacggggacccgcacaagcggtggagcatgtggtttaattcgaagatacgcgaagaaccttacctgggcttgatatccaactaatctcttagagataagagagtgctagcttgctagaaagttgagacaggtgctgcacggctgtcgtcagctcgtgtcgtgagatgttgggttaagtcccgcaacgagcgcaacccacgtatttagttgctaacagttcggctgagcactctaaatagactgccttcgcaaggaggaggaaggtgtggacgacgtcaagtcatcatggcccttatgcccagggcgacacacgtgctacaatggcatatacaatgagatgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggttggatcacctcctttctag

SEQ ID NO: 463 - DNA, 1515 bp, Campylobacter gracilis
aatatggagagtttgatcctggctcagagtgaacgctggcggcgtgcctaatacatgcaagtcgaacggaatttaagagagcttgctcttttaaatttagtggcgcacgggtgagtaatatatagctaatctgccccttgctggaggacaacagttagaaatgactgctaatactccatactcctttttaccataagataaatcgggaaagaatttcggcaagggatgagactatatcgtatcagctagtcggtggggtaacggcctaccgaggctatgacgcgtaactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagatatcaagaagaatacctattgcgaaggcgatctgctggaacttaactgacgctaatgcgtgaaagcgtggggagcaaacaggattagataccctggtagtccacgccctaaacgatgtataccggttgttgctgtgctagtcacggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcatatacaataagacgcaatatcgtaagatggagcaaatctaaaaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcgggaatgcgaaattcgctaccctccacagtggaatcagcgactggggtgaagtcgtaacaaggtaaccgtaggagaacctgcggttggatcacctcctttct

SEQ ID NO: 464 - DNA, 1515 bp, Campylobacter hominis
tttatatggagagtttgatcctggctcagagtgaacgctggcggcgtgcctaatacatgcaagtcgaacgaacgaataagagcttgctcttataagttagtggcgcacgggtgagtaatatatagctaatctgcctcttagtagaggataacagtcggaaacgattgctaatactctatacttctgctttacataagtaaagtagagaaagtttttcgctaagagatgaggctatactgtatcagctagttggtaaggtaacggcttaccaaggctatgacgcataactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttatcgggaaagaataatgacggtacccgatgaataagcaccggctaactccgtgccagcagccgcggtaatacggagggtgcaagcgttactcggaatcactgggcgtaaagggtgcgtaggtggattatcaagtctcttgtgaaatctaatagcttaactattaaattgcttgggaaactgatagtctagagtaggggagaggcagatggaactcttggtgtaggagtaaaatccgtagatatcaagaagaatacctattgcgaaagcgatctgctagaacctaactgacactgatgcacgaaagcgtggggagcaaacaggattagataccctggtagtccacgccctaaacgatgtataccggttgttgctttgctagtcaaggcagtaatccagctaacgcattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtatttagttgctaacagttaggctgagttctctaaatagactgccttcgtaaggaggaggaaggtgtggacgacgtcaagtcatcatggcccttatgtccggggcgacacacgtgctacaatgacatatacaatgagatgcaatatcgcaagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcggggatgcaaaatttgctaccctccacagtggaatcagcgactggggtgaagtcgtaacaaggtaaccgtaggagaacctgcggttggatcacctcctttct

SEQ ID NO: 465 - DNA, 1519 bp, Campylobacter jejuni
tttttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttctag

SEQ ID NO: 466 - DNA, 1519 bp, Campylobacter lari
tttttatggagagtttgatcctggctcagagtgaacgctggcggcgtgcctaatacatgcaagtcgaacgatgaagcgactagcttgctagttgtggattagtggcgcacgggtgagtaaggtatagttaatctgccctacacaagaggacaacagttggaaacggctgctaatactctatactcctgcttaacacaagttgagtagggaaagtttttcggtgtaggatgagactatatagtatcagctagttggtgaggtaatggctcaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatccaacggcttaaccgttgaactgcttgggaaactggtaatctagagtgggggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtatgctagttgttggggtgctagtcatctcagtaatgcagctaacgcattaagcataccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacacttcgggtgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttctag

SEQ ID NO: 467 - DNA, 1515 bp, Campylobacter rectus
ttaatatggagagtttgatcctggctcagagtgaacgctggcggcgtgcctaatacatgcaagtcgaacggagattaagtagcttgctatttaatcttagtggcgcacgggtgagtaatatatagctaatctgccctacactagaggacaacagttggaaacgactgctaatactctatactccttctttacataagttaagtcgggaaagtttttcggtgtaggatgaggctatatcgtatcagctagttggtagggtaacggcctaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcgtatacaataagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 468 - DNA, 1515 bp, Campylobacter showae
ttaatatggagagtttgatcctggctcagagtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtatctatataagtagatacgggaaagtttttcggtaatggatagggctatatcgtatcagctagttggtaaggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttct

SEQ ID NO: 469 - DNA, 1420 bp, Campylobacter sp. FOBRC14
agagtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtatctatataagtagatacgggaaagtttttcggtaatggatagggctatatcgtatcagctagttggtagggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttggggaagaaatttgacggtacccaaggaataagcaccggctaactccgtgccagcagccgcggtaatacggagggtgcaagcgttactcggaatcactgggcgtaaaggacgcgtaggcggattatcaagtctcttgtgaaatccaatggcttaaccattgaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaa

SEQ ID NO: 470 - DNA, 1428 bp, Campylobacter sp. FOBRC15
agtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtgtctatataagtagatacgggaaagtttttcggtaatggatagggctatatcgtatcagctagttggtaaggtaatggcttaccaaggctatgacgcgtaactggtctgagaggatgatcagtcacactggaactgagacacggtccagactcctacgggaggcagcagtagggaatattgctcaatggggggaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcgtatacaatgagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaactggttatggtccacagtggaatcagcgactg

SEQ ID NO: 471 - DNA, 1505 bp, Campylobacter sp. oral clone BB120
gagagtttgattctggctcagagtgaacgctggcggcgtgcctaatacatgcaagtcgaacggagattaaatagcttgctatttaatcttagtggcgcacgggtgagtaatgtatagttaatctgccccatagtggaggacaacagttagaaatgactgctaatactccatactccttcttatcataagttaagtcgggaaagtttttcgctatgggatgagactatatcgtatcagttagttggtaaggtaatggcttaccaaggctatgacgcgtaactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaaggacgcgtaggcggattatcaagtctcttgtgaaatctagtggcttaaccactaaactgcttgggaaactgataatctagagtaagggagaggcagatggaattcttggtgtaggggtaaaatccgtagagatcaagaagaatacttattgcgaaggcgatctgctagaacttaactgacgctaatgcgtgaaagcgtggggagcaaacaggattagataccctggtagtccacgccctaaacgatgtatactggttgttgctatgctagtcatggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacagtttagctgagcactctaatgagactgccttcgtaaggaggaggaaggtgtggacgacgtcaagtcatcatggcccttatgtccagggcgacacacgtgctacaatggcatatacaatgagatgcaatatcgcgagatggagcgaatctataaaatatgtcccagttcggattggagtctgcaactcgactccatgaagtcggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggytkgawcacctccttc

SEQ ID NO: 472 - DNA, 1695 bp, Campylobacter sputorum
  modified_base (8)..(8): a, c, t, g, unknown or other
agtgaacnctggcggcgtgcctaatacatgcaagtcgaacgatgaagtcctagcttgctaggatggattagtggcgcacgggtgagtaatgtatagctaatctgccccatagagaggaacaacacttagaaatgagtgctaatacctcatactccaattatacataagtttaattgggaaatgtagctcttaataatatatatcaaagataatttataaataaaaagttataaatataacaataagcttttttgaagctttatattaataaagcgaaaaaaaagcaaagcagttagatttaataaatttttatagcatttaaaaatacaaaagacttaatttttaaatctaaatataaattattactaatatttttaatagtcatttagaaatatcttaatatatattattaagagctttcgctatgggatgaggctatattgtatcagctagttggtaaggtaatggcttaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttctttgggaagaataatgacggtaccaaaggaataagcaccggctaactccgtgccagcagccgcggtaatacggagggtgcaagcgttactcggaatcactgggcgtaaaggacgcgtaggtggatagataagtctcttgtgaaatctagtagcttaactactaaactgcttgggaaactatctatctagagtaagggagaggcagatggaattcttggtgtaggggtaaaatccgtagatatcaagaggaatacttattgcgaaggcgatctgctagaacttaactgacactaatgcgtgaaagcgtggggagcaaacaggattagataccctggtagtccacgccctaaacgatgtatactggttgttgctgtgctagtcatggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtgtttagttgctaacagttaggctgagcactctaaacagactgccttcgtaaggaggaggaaggtgtggacgacgtcaagtcatcatggcccttatgtccggggcgacacacgtgctacaatggcatatacaataagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaattggttatggtccacagtggaatcagcgactggggtgaagtcgtaacaaggtaaccgtaggagaac

SEQ ID NO: 473 - DNA, 1513 bp, Campylobacter upsaliensis
tatggagagtttgatcctggctcagagtgaacgctggcggcgtgcctaatacatgcaagtcgaacgatgaagcttttagcttgctagaagtggattagtggcgcacgggtgagtaaggtatagttaatctgccctacactgggggacaacacttagaaatgagtgctaataccccatactcctatttaacataagttaggtagggaaagtttttcggtgtaggatgagactatatagtatcagctagttggtaaggtaaaggcttaccaaggctatgacgcttaactggtctgagaggatgatcagtcacactggaactgagacacggtccagactcctacgggaggcagcagtagggaatattgcgcaatgggcgaaagcctgacgcagcaacgccgcgtggaggatgacacttttcggagcgtaaactccttttctttgggaagaattttgacggtaccaaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtatgctagttgttggggtgctagtcatctcagtaatgcagctaacgcattaagcataccgcctggggagtacggtcgcaagattaaaactcaaaggaatagacggggacccgcacaagcggtggagcatgtggtttaattcgaagatacgcgaagaaccttacctaggcttgatatccaacaaattctgtagagatacggaagtgctagcttgctagaatgttgagacaggtgctgcacggctgtcgtcagctcgtgtcgtgagatgttgggttaagtcccgcaacgagcgcaaccctcgtccttagttgctaacgattcggtcgagcactctaaggagactgccttcgtaaggaggaggaaggtggggacgacgtcaagtcatcatggcccttacgcctagggcgacacacgtgctacaatggcatatacaatgagacgcaataccgcgaggtggagcaaatctataaaatatgtcccagttcggattgttctctgcaactcgagagcatgaagccggaatcgctagtaatcgcaaatcagccatgttgcggtgaatacgttcccgggtcttgtactcaccgcccgtcacaccatgggagttgatttcactcgaagtggaaatactaaactagttatcccccacagtggaatcagcgactggggtgaagtcgtaacaaggtaaccgtaggagaacctgcggttggatcacctcctttct

SEQ ID NO: 474 - DNA, 1508 bp, Candidatus Arthromitus sp. SFB-mouse-Yit
agagtttgatcctggctcaggacgaacgctggcggcgtgcctaacacatgcaagttgagcggagatatatggagcttgctttatataacttagcagcgaacgggtgagtaacacgtagataatctatcctatactgggggatagcccgatgaaagttggattaataccgcatatagctatatagttgcatgattatgtagtgaaagatttattggtataggaggagtctgcggcacattagctagtaggtgaggtaaaggcttacctaggcgacgatgtgtagccggtctgagaggatgaacggccacaatggaactgagacacggtccatactcctacgggaggcagcagtggggaatattgcacaatgggggaaaccctgatgcagcaacgccgcgtgagtgaagaaggttttcggattgtaaagctctgttagcagggaagaggaaggacggtacctgcagaggaagccacggctaactacgtgccagcagccgcggtaatacgtaggtggcaagcgttgttcggaataactgggcgtaaaggatgcgtaggcggttaaacaagttatatgttaaatatataggcttaacctgtagaaagcatataaaactgtttaactagagtgcaggagaggtaagtggaattcctagtgtagcggtgaaatgcgtagagattaggaagaacaccagtggcgaaggcgacttactggactgtaactgacgctgaggcatgagagcatggggagcaaacaggattagataccctggtagtccatgctgtaaacgatgggtactaggtgtgggttgtgaataacaattcgtgccgtcgcaaacgcaataagtaccccgcctgaggagtacgatcgcaagattaaaactcaaaggaattgacggggacccgcacaagcagcggagcatgtggtttaattcgaagcaacgcgaagaaccttacctaaacttgacataccttgaattaccttgtaatgagggaagctcgcaagagcaaggatacaggtggtgcatggttgtcgtcagctcgtgtcgtgagatgttgggttaagtcccgcaacgagcgcaacccttgttgttaattgctaacaggttaagctgagcactttagcgagacagcctaggttaactaggaggaaggtggggatgacgtcaaatcatcatgccccttacgtttagggctacacacgtgctacaatggtgagaacagagagaagcaagctagtgatagtgagcaaaacttataaaactcatctcagttcggattgcaggctgaaactcgcctgtatgaagatggagttgctagtaatcgcgaatcagaatgtcgcggtgaatacgttcccgggtcttgtacacaccgcccgtcacaccatgagagttggcaacacccgaaacctgtgggctaaccatataggaggcagcagtctaaggtggggtcagtgattggggtgaagtcgtaacaaggtagccgtaggagaacctgcggctggatcacct

SEQ ID NO: 475 - DNA, 1541 bp, Candidatus Sulcia muelleri
acaatgaagagtttgatccttgctcaggataaacgctagcggagggcctaacacatgcaagtcgaggggcagcaaaaaaaatataagtttacttatattttttgttggcgaccggcaaacgggtgagtaatacatacgtaacttaccttatgctgagggatagcctgaggaaacttggattaataccttataaaacaatcttttataaagaaatattgttaaaattttagatggcataaaataggcgtatgtccgattagttagttggtaaggtaatggcttaccaagacaatgatcggtagggggcctgagagggcgtacccccacattggtactgagacacggaccaaactcctacgggaggcagcagtgaggaatattggtcaatggaggaaactctgaaccagccactccgcgtgcaggatgaaagccttatgggttgtaaactgcttttgtatatgaataaaaaattctatttttagaaaaaattgaaggtaatatacgaataagtatcggcaaactccgtgccagcagccgcggtaaaacggaggatacaagcgttatccggatttattgggtttaaagggtgcgtaggcggttttttaagtcagtagtgaaatcttaaagcttaactttaaaattgctattgatactgagagacttgagttaggttggagtagctggaatgtgtggtgtagcggtgaaatgcatagatatcacacagaacaccgatcgcgaaagcaagttactaagcctatactgacgctgaggcacgaaagcgtggggagcaaacaggattagataccctggtagtccatgccgtaaacgatgatcactaactattggttttttataattcagtggtcaagcgaaagtgataagtgatccacctgagaagtacgaccgcaaggttgaaactcaaaggaattgacgggggcccgcacaatcggtggagcatgtggtttaattcgatgatacgcgaggaaccttaccaagacttaaatgtactacgaataaattggaaacaatttagtcaaacgacggagtacaaggtgctgcatggttgtcgtcagctcgtgccgtgaggtgttaggttaagtcctttaacgagcgcaacccttatgattagttgccatcgagtaatgttggggactctaataagactgccggcgtaagccgagaggaaggtggggacgacgtcaaatcatcacggcccttacgtcttgggccacacacgtgctacaatggtcggtacaaaaggcagcgactgggtgaccagaagcaaatctctaaagccgatctcagttcggattggagtctgaaactcgactctatgaagctggaatcgctagtaatcgcgcatcagccatggcgcggtgaatacgttcccgggccttgtacacaccgcccgtcaagccatggaagttggaagtacctaaagtcggtgaccataaaaggagctgcctaaggtaagtctaataactagggctaagtcgtaacaaggtagccgtaccggaaggtgcggctggaatatctctgtt

SEQ ID NO: 476 - DNA, 1504 bp, Capnocytophaga canimorsus
agagtttgatcctggctcaggatgaacgctagcggcaggcctaacacatgcaagtcgaggggtagggtgcttcggcacttgagaccggcgcacgggtgcgtaacacgtgtacaatctaccttttgctaagggatagcccgaagaaatttggattaataccttatagtattgtttggtggcatcactaaataattaaagctctggtggcaaaagatgagtacgcgtcccattagctagttggtgtggtaacggcataccaaggctacgatgggtaggggtcctgagagggaggtcccccacactggtactgagacacggaccagactcctacgggaggcagcagtgaggaatattggacaatggtcggaagactgatccagccatgccgcgtgcaggatgacggccttatgggttgtaaactgcttttatacaggaagaataaggtctacgcgtagattgatgacggtactgtatgaataagcatcggctaactccgtgccagcagccgcggtaatacggaggatgcgagcgttatccggaatcattgggtttaaagggtccgtaggcgggcttataagtcagaggtgaaagcactgagctcaactgagtaactgcctttgaaactgtaggtcttgaatgtttgtgaagtagctggaatgtgtagtgtagcggtgaaatgcatagatattacacagaacaccgattgcgaaggcatgttactaacaaattattgacgctgatggacgaaagcgtggggagcgaacaggattagataccctggtagtccacgctgtaaacgatggatactagctgtttgggagtaattttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatgggaaacgacgtacctagagataggtatttcttcggacgtttttcaaggtgctgcatggttgtcgtcagctcgtgccgtgaggtgtcaggttaagtcctataacgagcgcaacccctgctgttagttgctagcgagttaagtcgagcactctaacgggactgccggtgcaaaccgtgaggaaggtggggatgacgtcaaatcatcacggcccttacatcttgggctacacacgtgctacaatggccggtacagcgagcagccactgcgtgagcaggagcgaatctataaagccggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagtcggttgccgcaaggagctgcctagggtaaaactagtgactggggctaagtcgtaacaaggtagccgtaccggaaggtgcggctggaacacct

SEQ ID NO: 477 - DNA, 1287 bp, Capnocytophaga genomosp. C1
gatgaacgctagcggcaggcctaacacatgcaagtcgagggaccggcgtacgggtgcgtaacgcgtatacaatctgcctttcactgggggatagcccgaagaaatttggattaataccccatagttaaaggtggtgaaagatgagtatgcgttctattagctagttggagaggtaacggctccccaaggcgatgatagataggggttctgagagggatgtcccccacactggtactgagatacggaccagactcctacgggaggcagcagtgaggaatattggacaatggtcggaagactgatccagccatgccgcgtgcaggatgacggcctatgggttgtaaactgcttttgtaagggaagatgacggtaccttacgaataagcatcggctaactccgtgccagcagccgcggtaatacggaggatgcgagcgttatccggaatcattgggtttaaagggtctgtaggcgggctggtaagtcagaggtgaaagcgcttagctcaactaagcaactgcctttgaaactgttggtcttgaatggttgtgaagtagttggaatgtgtagtgtagcggtgaaatgcttagatattacacagaacaccgatagcgaaggcatattactaacaatattgacgctgatggacgaaagcgtggggagcgaacaggattagataccctggtagtccacgctgtaaacgatggatactagctgtttggtattgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggtcaaggtgctgcatggttgtcgtcagctcgtgccgtgaggtgtcaggttaagccctataacgagcgcaacccctgccattagttgctaacgatcgagccctctaatgggactgccggtgcaaaccggaggaaggtggggatgacgtcaaatcatcacggcccttacatcttgggctacacacgtgctacaatggccgtcagagagcagccactgcgtgagcaggcgcgaatctatacggtcacagttcggacggagtctgcaactcgactccggaagctggaatcgctagtaatcggatatcagccatgatccggtgaatacgttcccgggccttgtacacaccgcccgtcaagccatggaagctgggagtacctgaagacggttgctgtttagggtaaaactagtgactggggc

SEQ ID NO: 478 - DNA, 1509 bp, Capnocytophaga gingivalis
tgaagagtttgatcctggctcaggatgaacgctagcggcaggcctaacacatgcaagtcgagggagaagccctttcgggggcagaaaccggcgcacgggtgcgtaacgcgtatgcaacctacctttcacagggggatagcccgaagaaatttggattaataccccataatattattggatggcatcatttgataattaaaactgcggtggtgaaagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtacgtgtacattgatgacggtaccatatgaataagcatcggctaactccgtgccagcagccgcggtaatacggagggtgcgagcgttattcggaatcattgggtttaaagggtctgtaggcgggctattaagtcagaggtgaaaggtttcagcttaactgagaaattgcctttgatactggtagtcttgaatatctgtgaagttcttggaatgtgtagtgtagcggtgaaatgcttagatattacacagaacaccgattgcgaaggcaggggactaacagacaattgacgctgagagacgaaagcgtggggagcgaacaggattagataccctggtagtccacgctgtaaacgatggatactagctgtttggcgcaagctgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggggactgacaggtgtagagatacgcccttcttcggacagttttcaaggtgctgcatggttgtcgtcagctcgtgccgtgaggtgtcaggttaagccctataacgagcgcaacccctattgttagttaccagcacgtaaaggtggggactctagcaagactgccggtgtaaaccgtgaggaaggtggggatgacgtcaaatcatcacggcccttacatcttgggctacacacgtgctacaatggtcgttacagagagcagccactgcgcgagcaggagcgaatctataaagacgatcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggtcaccgcaaggagctgcctagggtaaaaccagtgactggggctaagtcgtaacaaggtagccgtaccggaaggtgtggctggaacacctcctt

SEQ ID NO: 479 - DNA, 1417 bp, Capnocytophaga granulosa
  modified_base (28)..(28): a, c, t, g, unknown or other
aggcctaacacatgcaagtcgagggagnaagcccttcggggtagaaaccggcgcacgggtgcgtaacgcgtatgcaacctacctttcacagggggatagcccgaagaaatttggattaataccccataatattattggatggcatcatttgataattaaaattacgatggtgaaagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggagtacgtgtactttgatgacggtaccatatgaataagcatcggctaactccgtgccagcagccgcggtaatacggaggatgcgagcgttattcggaatcattgggtttaaagggtctgtaggcgggctattaagtcaggggtgaaaggtttcagcttaactgagaaattgcctttgatactggtagtcttgaaaatctgtgaagttcttggaatgtgtagtgtagcggtgaaatgcttagatattacacagaacaccgattgcgaaggcaggggactaacagacgattgacgctgagagacgaaagcgtggggagcgaacaggattagataccctggtagtccaccctgtaaacgatggatactagctgtttggagtaatttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggagactgacaggggcagagatgcctttttcttcggacagttttcaaggtgctgcatggttgtcgtcagctcgtgccgtgaggtgtcaggttaagtcctataacgagcgcaacccctattgttagttaccagcacgtagtggtggggactctagcaagactgccggtgtaaaccgtgaggaaggtggggatgacgtcaaatcatcacggcccttacatcttgggctacacacgtgctacaatggtcgttacagagagcagccactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggttgccgcaaggagctgcctagggtaaaaccagtgactgggg

SEQ ID NO: 480 - DNA, 1518 bp, Capnocytophaga ochracea
acgatgaagagtttgatcctggctcaggatgaacgctagcggcaggcctaacacatgcaagtcgagggggaagttactttcgggtaacagagaccggcgtacgggtgcgtaacgcgtatacaatctgcctttcactgggggatagcccgaagaaatttggattaataccccatagtatatagggacggcatcgtttttatattaaagctctggtggtgaaagatgagtatgcgttctattagctagttggagaggtaacggctccccaaggctatgatagataggggttctgagagggatgtcccccacactggtactgagatacggaccagactcctacgggaggcagcagtgaggaatattggacaatggtcggaagactgatccagccatgccgcgtgcaggatgactgccttatgggttgtaaactgcttttgtaagggaagaataagggctacgcgtagtttgatgacggtaccttacgaataagcatcggctaactccgtgccagcagccgcggtaatacggaggatgcgagcgttatccggaatcattgggtttaaagggtccgtaggcgggctaataagtcaggggtgaaatcgttcagctcaactgagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattagataccctggtagtccacgctgtaaacgatggatactagctgtttggagtaatctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggggactgacagaggtagagatacctttttcttcggacagttttcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgtgaggaaggtggggatgacgtcaaatcatcacggcccttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagacggttaccgcgaggagctgtttagggtaaaactagtgactggggctaagtcgtaacaaggtagccgtaccggaaggtgcggctggaacacctcctttct

SEQ ID NO: 481 - DNA, 1405 bp, Capnocytophaga sp. GEJ8
gcctacacatgcaagtcgagggggaagttactttcgggtaacagagaccggcgtacgggtgcgtaacgcgtatacaatctgcctttcactgggggatagcccgaagaaatttggattaataccccatagtatagtaatacggcatcgtgatactattaaagcttaggtggtgaaagatgagtatgcgttctattagttagttggagaggtaacggctccccaaggcgatgatagataggggttctgagagggatgtcccccacactggtactgagatacggaccagactcctacgggaggcagcagtgaggaatattggacaatggtcggaagactgatccagccatgccgcgtgcaggatgaaggtcttatggattgtaaactgcttttgtaagggaagaataagggctacgtgtagtttgatgacggtaccttacgaataagcatcggctaactccgtgccagcagccgcggtaatacggaggatgcgagcgttatccggaatcattgggtttaaagggtctgtaggcgggctggtaagtcagaggtgaaagcgctcagctcaactgaggcaactgcctttgaaactgttggtcttgaatggttgtgaaagtagttggaatgtgtagtgtagcggtgaaatgcttagatattacacagaacaccgatagcgaaggcatattactaacaattgattgacgctgatggacgaaagcgtggggagcgaacaggattagataccctggtagtccacgctgtaaacgatggatactagctgtttggtcgcgagtttgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggggactgacaggggtagagatacccttttcttcggacagttttcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgagaggaaggtggggatgacgtcaaatcatcacggcccttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggttaccgcaaggagctgttaggtaaa

SEQ ID NO: 482 - DNA, 1450 bp, Capnocytophaga sp. S1b
  modified_base (31)..(31): a, c, t, g, unknown or other
  modified_base (83)..(83): a, c, t, g, unknown or other
  modified_base (376)..(376): a, c, t, g, unknown or other
  modified_base (409)..(409): a, c, t, g, unknown or other
  modified_base (449)..(449): a, c, t, g, unknown or other
  modified_base (455)..(455): a, c, t, g, unknown or other
  modified_base (513)..(514): a, c, t, g, unknown or other
  modified_base (523)..(523): a, c, t, g, unknown or other
  modified_base (772)..(772): a, c, t, g, unknown or other
  modified_base (1001)..(1003): a, c, t, g, unknown or other
  modified_base (1062)..(1062): a, c, t, g, unknown or other
  modified_base (1077)..(1077): a, c, t, g, unknown or other
  modified_base (1113)..(1113): a, c, t, g, unknown or other
  modified_base (1215)..(1215): a, c, t, g, unknown or other
  modified_base (1419)..(1419): a, c, t, g, unknown or other
  modified_base (1441)..(1441): a, c, t, g, unknown or other
acgatgaagagtttgatcctggctcaggatnaacgctagcggcaggcctaacacatgcaagtcgaggagaagccttcgggctnaraccggcgyacgggtgcgtaacgcgtatacaatctgcctttcactgggggatagcccgaagaaatttggattaataccccatagtatagtaatacggcatcgtgatactattaaagcttaggtggtgaaagatgagtatgcgttctattagctagttggagaggtaacggctccccaaggctatgatagataggggttctgagagggatgtcccccacactggtactgagatacggaccagactcctacgggaggcagcagtgaggaatattggacaatggtcggaagactnatccagccatgccgcgtgcaggatgaaggtctnatggattgtaaactgcttttgtaagggaagaataaggctncgcgtngtttgatgacggtaccttacgaataagcatcggctaactccgtgccagcagccgcggnnatacggagnatgcgagcgttatccggaatcattgggtttaaagggtctgtaggcgggcttgtaagtcagaggtgaaagcgctcagctcaactgagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattngataccctggtagtccacgctgtaaacgatggatactagctgtttggtttaaggattgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggtttaaatggrgactgacaggggtagagatacgnnnttcttcggacagttttcaaggtgctgcatggttgtcgtcagctcgtgccgtgaggtgtnaggttaagtcctatnacgagcgcaacccctgccattagttgctaacgagtnaagtcgagccctctaatgggactgccggtgcaaaccgtgaggaaggtggggatgacgtcaaatcatcacggcccttacatcttgggctacacacgtgctacnatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggttnccgcaaggagctgtttagggtnaaactagtg

SEQ ID NO: 483 - DNA, 1442 bp, Capnocytophaga sp. oral clone AH015
  modified_base (537)..(537): a, c, t, g, unknown or other
ggctcaggatgaacgctagcggcaggcctaacacatgcaagtcgagggagaagcctttcggggcagaaaccggcgcacgggtgcgtaacgcgtatgcaacctacctttcacagggggatagcccgaagaaatttggattaataccccataatattgttggatggcatcatctgataattaaaactgtggtggtgaaagatgggcatgcgtcctattagctagttggagtggtaacggcaccccaaggctatgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtaacgtgtacattgatgacggtaccatatgaataagcatcggctaactccgtgccagcagccgcggtaatacggaggatgcgagcgttattcggaatcattgggtntaaagggtctgtaggcgggctattaagtcaggggtgaaaggtttcagcttaactgagaaattgcctttgatactggtagtcttgaatatctgtgaagttcttggaatgtgtagtgtagcggtgaaatgcttagatattacacagaacaccgattgcggaggcaggggactaacagacgattgacgctgagagacgaaagcgtggggagcgaacaggattmgataccctggtagtccacgctgtaaacgatggatactagctgtttggagaaatttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtytaaatggagactgacaggggcagagatgcctttttcttcggacagttttcaaggtgctgcatggttgtcgtcagctcgtgccgtkaggtgtcaggttaagtcctataacgagcgcaacccctattgttagttaccagcacgtaatggtggggactcwagcaagactgccggtgtaaaccgtgaggaaggtggggatgacgtcaaatcatcacggcccttacatcttgggctacacacgtgctacaatggtcgttacagagagcagscactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggwagctgggggtacctgaagtcggttgccgcaaggagctgcctagggtaaaaccagtgactggggct

SEQ ID NO: 484 - DNA, 1529 bp, Capnocytophaga sp. oral clone ASCH05
  modified_base (974)..(974): a, c, t, g, unknown or other
  modified_base (1016)..(1016): a, c, t, g, unknown or other
gagagtttgatcatggctcaggatgaacgctagctacaggcttaacacatgcaagtcgaggggagaggttaccttcgggtaactgaaaccggcgcacgggtgcgtaacgcgtatacaatctgcctttcacatagggatagcccgaagaaatttggattaatacctaatggtatataagagcggcatcgtttttatattaaagctacggtggtgaaagatgagtatgcgttctattagctagttggagaggtaacggctccccaaggcgacgatagataggggttctgagagggatgtcccccacactggtactgagatacggaccagactcctacgggaggcagcagtgaggaatattggacaatggtcggaagactgatccagccatgccgcgtgcaggatgaaggtcctatggattgtaaactgcttttgtaagggaagaataaggagtacgtgtactttgatgacggtaccttacgaataagcatcggctaactccgtgcccgcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgctggatgcccgctgttggttcattagagtcagcggccaagcgaaagtgataagtatcccacctgggggagtacgcacgcaagtgtgaaactcaaaggaattgacgggggcccgcacaagccggaggaacatgtggtttaattcgatgatacgcgaggaaccttaccaaggngttgaatgggaactgacagaggtagagatgaagaggcccttncggacagttttcaaggtgctgcatggttgtcgtcagctcttgccgtgaggtgtcggcttaagtgccataacgagcgcaaccccttttcttagttgccatcaggtcatgctgggcactctgggaatactgccaccgtaaggtgtgaggaaggtggggatgacgtcaaatcatcacggcccttacatcttgggctacacacgtgctacaatgggctttaatagaggggagcgaagccgcgaggtggagcaaaccccagaaacaagctctcagttcggatcggagtctgcaactcgactccgtgaagctggaatcgctagtaatcggatatcagccatgatccggtgaatacgttcccgggccttgtacacaccgcccgtcacacaacgaaagtcggaagtacccaaagccggtggggtaaccttcgggagccagccgtctaaggtaaagtcgatgattggggtgaagtcgtaacaaggtagccgtatcggaaggtgcggctggaacacctccttc

SEQ ID NO: 485 - DNA, 1357 bp, Capnocytophaga sp. oral clone ID062
gagtttgattctggctcaggatgaacgctagcggcaggcctaacacatgcaagtcgagggaccggcgcacgggtgcgtaacgcgtatataatctaccttatacagagggatagcccgaagaaatttggattaatacttcatagttaaaggcggtataagatgagtatgcgtcctattagctagttggtatggtaacggcataccaaggctacgataggtaggggtcctgagagggagatcccccacactggtactgagacacggaccagactcctacgggaggcagcagtgaggaatattggtcaatgggcgagagcctgaaccagccaagtcgcgtgaaggatgactgtctatggattgtaaacttcttttatacgggaatatgcatgtaccgtatgaataagcatcggctaactccgtgccagcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatattacacagaacaccgatagcgaaggcatattactaacaatatcgacgctgatggacgaaagcgtggggagcgaacaggattagataccctggtagtccacgctgtaaacgatggatactagctgtttggatatgagtggctaagcgaaagtgataagtatcccacctggggagtacgcacgcaagtgtgaaactcaaaggaattgacgggggcccgctcaagcggtggagcatgtggtttaattcgatgatacgcgaggaaccttaccaaggtttaaatggtcaaggtgctgcatggttgtcgtcagctcgtgccgtgaggtgtcaggttaagtcctataacgagcgcaacccctgccattagttgctaacgatcgagccctctagtgggactgccggtgcaaaccggaggaaggtggggatgacgtcaaatcatcacggcccttacatcttgggctacacacgtgctacaatggccgtcagagagcagccactgcgcgagcaggagcgaatctatacggtcacagttcggacggagtctgcaactcgactccggaagctggaatcgctagtaatcggatatcaaccatgatccggtgaatacgttcccgggccttgtacacaccgcccgtcaagccatggaagctgggggtacctgaaggcggtcgctgattagggtaaaactagtgactggggctaagtcgtaacaaggtagccgtaccggaaggtgcgggtggatcacctcctt

SEQ ID NO: 486 - DNA, 1509 bp, Capnocytophaga sp. oral strain A47ROY
  modified_base (888)..(888): a, c, t, g, unknown or other
  modified_base (895)..(896): a, c, t, g, unknown or other
  modified_base (955)..(955): a, c, t, g, unknown or other
  modified_base (979)..(979): a, c, t, g, unknown or other
  modified_base (999)..(999): a, c, t, g, unknown or other
  modified_base (1016)..(1016): a, c, t, g, unknown or other
  modified_base (1019)..(1019): a, c, t, g, unknown or other
agagtttgatcctggctcaggatgaacgctagcggcaggcctaacacatgcaagtcgagggggaagttactttcgggtaactgagaccggcgtacgggtgcgtaacgcgtatacaatctgcctttcactgggggatagcccgaagaaatttggattaataccccatagtatagtagtgtggcatcacacaactattaaagccttggtggtgaaagatgagtatgcgttctattagctagttggagaggtaacggctccccaaggctacgatagataggggttctgagagggatgtcccccacactggtactgagatacggaccagactcctacgggaggcagcagtgaggaatattggacaatggtcggaagactgatccagccatgccgcgtgcaggatgacggccttatgggttgtaaactgcttttgtaagggaagaataaggagtacgtgtactttgatgacggtaccttacgaataagcatcggctaactccgtgccagcagccgcggtaatacggaggatgcgagcgttatccggaatcattgggtttaaagggtccgtaggcgggctaataagtcagaggtgaaagcgcttagctcaactaagcaactgcctttgaaactgttggtcttgaatggttgtgaagtagttggaatgtgtagtgtagcggtgaaatgcttagatattacacagaacaccgatagcgaaggcatattactaacaattaattgacgctgatggacgaaagcgtggggagcgaacaggattagataccctggtagtccacgctgtaaacgatggatactagctgtttggtctaaggattgagtggctaagcgaaagtgataagtatcccacctggggagtacgttcgcaagaatganactcaanngaattgacgggggcccgcacaagcggtggagcatgtggtttaattcgatgatacgcgangaaccttcccagggtttaaatggngactgacagatgtagagatncctccttcttcggacanttntcaaggtgctgcatggttgtcgtcagctcgtgccgtgaggtgtcaggttaagtcctataacgagcgcaacccctgccattagttgctaacgagtaaggtcgagccctctaatgggactgccggtgcaaaccgtgaggaaggtggggatgacgtcaaatcatcacggcctttacatcttgggctacacacgtgctacaatggccgttacagagagcagccactgcgtgagcaggcgcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagacggtcaccgcaaggagctgtttagggtaaaactagtgactggggctaagtcgtaacaaggtagccgtaccggaaggtgcggctggatcacctccc

SEQ ID NO: 487 - DNA, 1463 bp, Capnocytophaga sp. oral strain S3
  modified_base (33)..(33): a, c, t, g, unknown or other
  modified_base (520)..(520): a, c, t, g, unknown or other
  modified_base (1008)..(1008): a, c, t, g, unknown or other
taacgatgaagagtttgatcctggctcaggatnaacgctagcggcaggcctaacacatgcaagtcgagggagaagcccttcggggcagaaaccggcgcacgggtgcgtaacgcgtatgcaacctacctttcacagggggatagcccgaagaaatttggattaataccccataatattgttggatggcatcattttgcaattaaaactgcggtggtgagagatgggcatgcgtcctattagctagttggagtggtaacggcaccccaaggctacgataggtaggggtcctgagagggagatcccccacactggtactgagacagggaccagactcctacgggaggcagcagtgaggaatattggtcaatggtcggaagactgaaccagccatgccgcgtgcaggaagaatgccttatgggttgtaaactgcttttatatgggaagaataaggtgtacgagtacattgatgacggtaccatatgaataagcatcggctaactccgtgccagcagccgcggtnatacggaggatgcgagcgttattcggaatcattgggtttaaagggtctgtaggcgggctattaagtcaggggtgaaaggtttcagcttaactgagaaattgcctttgatactggtagtcttgaatatctgtgaagttcttggaatgtgtagtgtagcggtgaaatgcttagatattacacagaacaccgattgcgaaggcaggggactaacagacaattgacgctgagagacgaaagcgtggggagcgaacaggattagataccctggtagtccacgctgtaaacgatggatactagctgtttgatgataagttgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggggactgacaggtgtagagatacgccnttcttcggacagttttcaaggtgctgcatggttgtcgtcagctcgtgccgtgaggtgtcaggttaagtcctataacgagcgcaacccctattgttagttaccagcacgtagtggtggggactctagcaagactgccggtgtaaaccgtgaggaaggtggggatgacgtcaaatcatcacggcccttacatcttgggctacacacgtgctacaatggtcgttacagagagcagccactgcgtgagcaggagcgaatctataaagacgatcacagttcggatcggagtctgcaactcgactccgtgaagctggaatcgctagtaatcggatatcagccatgatccggtgaatacgttcccgggccttgtacacaccgcccgtcaagccatggaagctgggagtacctgaagtcggtgaccgcaaggagctgcctagggtaaaaccagtgactggggc

SEQ ID NO: 488 - DNA, 1516 bp, Capnocytophaga sp. oral taxon 338
acgatgaagagtttgatcctggctcaggatgaacgctagcggcaggcctaacacatgcaagtcgagggagaagcccttcggggcagaaaccggcgcacgggtgcgtaacgcgtatgcaacctacctttcacagggggatagcccggagaaatttggattaatatcccataatattgttggatggcatcatttggcaattaaagttacgatggtggaagatgggcatgcgtcctattagctagttggcgaggtaacggctcgccaaggcgacgataggtaggggtcctgagagggagatcccccacactggtactgagacagggaccagactcctacgggaggcagcagtgaggaatattggtcaatggtcggaagactgaaccagccatgccgcgtgcaggaaggcggccttatgggttgtaaactgcttttatatgggaagaataaggagtacgtgtactttgatgacggtaccatatgaataagcatcggctaactccgtgccagcagccgcggtaatacggaggatgcgagcgttattcggaatcattgggtttaaagggtctgtaggcgggctattaagtcaggggtgaaatatttcagcttaactgggaaattgcctttgatactggtagtcttgaatatttgtgaagtttttggaatgtgtagtgtagcggtgaaatgcatagatattacacagaacaccgattgcggaggcaggggactaacaaataattgacgctgagagacgagagcgtggggagcgaacaggattagataccctggtagtccacgctgtaaacgatggatactagctgtttggtaggaatattgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatggtgactgacgtacctagagatgggtatttcttcggacagttatcaaggtgctgcatggttgtcgtcagctcgtgccgtgaggtgtcaggttaagtcctataacgagcgcaacccctattgatagttaccagcacgtaaaggtggggactctattgagactgccggtgtaaaccgtgaggaaggtggggatgacgtcaaatcatcacggcccttacatcttgggctacacacgtgctacaatggtcgttacagagagcagctactgcgtgagcaggtgcgaatcttaaaagacggtcacagttcggatcggagtctgcaactcgactccgtgaagctggaatcgctagtaatcgcatatcagccatgatgcggtgaatacgttcccgggccttgtacacaccgcccgtcaagccatggaagctgggagtacctgaagttggttaccgcaaggagctacctagggtaaaaccagtgactggggctaagtcgtaacaaggtagccgtaccggaaggtgtggctggaacacctcctttct

SEQ ID NO: 489 - DNA, 1518 bp, Capnocytophaga sputigena
acgatgaagagtttgatcctggctcaggatgaacgctagcggcaggcctaacacatgcaagtcgagggagaggttaccttcgggtaaccaaaaccggcgcacgggtgcgtaacgcgtatacaatctgcctttcacatagggatagcccgaagaaatttggattaatacctaatggtatataggagcggcatcgtttttatattaaagctacggtggtgaaagatgagtatgcgttctattagctagttggagaggtaacggctccccaaggcgacgatagataggggttctgagagggatgtcccccacactggtactgagatacggaccagactcctacgggaggcagcagtgaggaatattggacaatggtcggaagactgatccagccatgccgcgtgcaggatgaaggtcctatggattgtaaactgcttttgtaagggaagaataaggagtacgtgtactttgatgacggtaccttacgaataagcatcggctaactccgtgccagcagccgcggtaatacggaggatgcgagcgttatccggaatcattgggtttaaagggtccgtaggcgggctgataagtcagaggtgaaagcgcttagctcaactaagcaactgcctttgaaactgtcagtcttgaatgattgtgaagtagttggaatgtgtagtgtagcggtgaaatgcttagatattacacagaacaccgatagcgaaggcatattactaacaatttattgacgctgatggacgaaagcgtggggagcgaacaggattagataccctggtagtccacgctgtaaacgatggatactagctgtttggagcaatctgagtggctaagcgaaagtgataagtatcccacctggggagtacgcacgcaagtgtgaaactcaaaggaattgacgggggcccgcacaagcggtggagcatgtggtttaattcgatgatacgcgaggaaccttaccaaggtttaaatgggaactgacagaggtagagatacctccttcttcggacagttttcaaggtgctgcatggttgtcgtcagctcgtgccgtgaggtgtcaggttaagtcctataacgagcgcaacccctgccattagttgctaacgagtcaagtcgagccctctagtgggactgccggtgcaaaccgtgaggaaggtggggatgacgtcaaatcatcacggcccttacatcttgggctacacacgtgctacaatggccgttacagagagcagccactgcgcgagcaggagcgaatctataaagacggtcacagttcggatcggagtctgcaactcgactccgtgaagctggaatcgctagtaatcggatatcagccatgatccggtgaatacgttcccgggccttgtacacaccgcccgtcaagccatggaagctgggggtacctgaagacggtcaccgcgaggagctgtttagggtaaaactagtgactggggctaagtcgtaacaaggtagccgtaccggaaggtgcggctggaacacctcctttct

SEQ ID NO: 490 - DNA, 1534 bp, Cardiobacterium hominis
gaactgaagagtttgattctggctcagattgaacgctggcggcatgcttaacacatgcaagtcgaacggaaacgatggagcttgctccaggcgtcgagtggcggacgggtgagtaacgcatgggaatctgccttttgctgggggataacgtagggaaacttacgctaataccgcataagacctaagggtgaaagcgggggaccgaaaggcctcgcggcaagagatgagcccatgttggattagctagttggtggggtaaaggcctaccaaggcgacgatccatagctggtctgagaggatgatcagccacactgggactgagacacggcccagactcctacgggaggcagcagtggggaatattggacaatggggggaaccctgatccagcaatgccgcgtgtgtgaagaaggccttcgggttgtaaagcactttcagtagggaggaaaggtgcgtagttaatacctgcgcaattgacgttacctacagaagaagcaccggctaactccgtgccagcagccgcggtaatacggagggtgcgagcgttattcggaattactgggcgtaaagcgcacgcaggcggttgcccaagtcagatgtgaaagccccgggcttaacctgggaactgcatttgaaactgggcgactagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgttaaagactcggtgccggagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatcctaggaacttggcagagatgccttggtgccttcgggaacctagagacaggtgttgcatggctgtcgtcagctcgtgtcgtgagatgttgggttaagtcccgcaacgagcgcaacccttatccttacttgccagcactttgggtgggaactgtaaggagactgccggtgacaaaccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacttaggagggcgcttgccacggtgtggccgatgactggggtgaagtcgtaacaaggtaaccgtaggggaacctgcggttggatcacctccttt

SEQ ID NO: 491 - DNA, 1493 bp, Cardiobacterium valvarum
gcgtgcttaacacatgcaagtcgaacggaaacgacggagcttgctccgggcgtcgagtggcggacgggtgagtaatgcatgggaatctgccttttgctgggggataacgtagggaaacttacgctaataccgcataagacctgagggtgaaagtgggggaccgttaaggcctcacggcagaagatgagcccatgtcggattagctagttggtggggtaaaggcctaccaaggcgacgatccgtagctggtctgagaggatgatcagccacactgggactgagacacggcccagactcctacgggaggcagcagtggggaatattggacaatgggggcaaccctgatccagcaatgccgcgtgtgtgaagaaggccttcgggttgtaaagcactttcagcagggaggaaagcatcatggttaacacccatggtagtgacgttacctgcagaagaagcaccggctaactccgtgccagcagccgcggtaatacggagggtgcaagcgttattcggaattactgggcgtaaagcgcacgcaggcggctacctaagtcagatgtgaaagccccgggcttaacctgggaactgcatttgaaactgggcagctagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgtatagactcggtgccgcagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatccagagaacttagcagagatgctttggtgccttcgggaactctgagacaggtgttgcatggctgtcgtcagctcgtgtcgtgagatgttgggttaagtcccgcaacgagcgcaacccttatccttacttgccagcacttagggtgggaactgtaaggagactgccggtgacaagccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacgaaagagggcgcttgccacggtgtggccgatgactggggtgaagtcgtaacaaggtaaccgtaggggaacctgcggttggatcacctcctac

SEQ ID NO: 492 - DNA, 1503 bp, Carnobacterium divergens
  modified_base (1)..(1): a, c, t, g, unknown or other
  modified_base (98)..(99): a, c, t, g, unknown or other
  modified_base (234)..(234): a, c, t, g, unknown or other
  modified_base (250)..(250): a, c, t, g, unknown or other
  modified_base (349)..(350): a, c, t, g, unknown or other
  modified_base (541)..(541): a, c, t, g, unknown or other
  modified_base (560)..(560): a, c, t, g, unknown or other
  modified_base (642)..(643): a, c, t, g, unknown or other
  modified_base (777)..(780): a, c, t, g, unknown or other
  modified_base (947)..(947): a, c, t, g, unknown or other
  modified_base (981)..(982): a, c, t, g, unknown or other
  modified_base (1037)..(1038): a, c, t, g, unknown or other
  modified_base (1043)..(1043): a, c, t, g, unknown or other
  modified_base (1067)..(1067): a, c, t, g, unknown or other
  modified_base (1114)..(1114): a, c, t, g, unknown or other
  modified_base (1401)..(1401): a, c, t, g, unknown or other
  modified_base (1424)..(1424): a, c, t, g, unknown or other
  modified_base (1500)..(1500): a, c, t, g, unknown or other
nttatatgagagtttgatcctggctcaggacgaacgctggcggcatgcctaatacatgcaagtcgaacgcacgaagttgaaaagcttgcttttcgatnnaagtaagtggcggacgggtgagtaacacgtgggtaacctgcccataagagggggataacattcggaaacggatgctaataccgcatatttcaagtgaccgcatggtcgcttgatgaaaggtggcttcggctaccncttatggatggacccncggtgcattagttagttggtgaggtaatggctcaccaagaccatgatgcatagccgacctgagagggtgatcggccacactgggactgagacacggccnngactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccncggtaatacgtaggtggcnagcgttgtccggatttattgggcgtaaagcgagcgcaggcggttctttaagtctgatgtgaaagcccccggctcaaccgggnngggtcattggaaactggagaacttgagtgcagaagaggagagtggaattccatgtgtagcggtgaaatgcgtagatatatggaggaacaccagtggcgaaggcgactctctggtctgtaactgacgctgaggcnnnnaagcgtggggagcaaacaggattagataccctggtagtccacgctgtaaacgatgagtgctaagtgttggagggtttccgcccttcagtgctgcagctaacgcattaagcactccgcctggggagtacgaccgcaaggttgaaactcaaaggaattgacggggaccngcacaagcggtggagcatgtggtttaattcgaannaacgcgaagaaccttaccaggtcttgacatcctttgaccactcgagagatcgagnnttccnttcggggacaaagtgacaggtggngcatggttgtcgtcagctcgtgtcgtgagatgttgggttaagtcccncaacgagcgcaacccttattactagttgccagcattcagttgggcactctagtgagactgccggtgacaaaccggaggaaggtggggatgacgtcaaatcatcatgccccttatgacctgggctacacacgtgctacaatggatggtacaacgagtcgcgaagtcgtgaggccaagctaatctcttaaagccattctcagttcggattgtaggctgcaactcgcctacatgaagccggaatcgctagtaatcgcggatcagaacgccgcggtgaatacgttcccggntcttgtacacaccgcccgtcacnccacgagagtttgtaacacccgaagccggtgaggtaaccttttaggagccagccgtctaaggtgggatagataatnggg

SEQ ID NO: 493 - DNA, 1547 bp, Carnobacterium maltaromaticum
agagtttgatcctggctcaggacgaacgctggcggcgtgcctaatacatgcaagtcgaacgcacgaagttgaagagcttgctctttaaccaagtgagtggcggacgggtgagtaacacgtgggtaacctgcccattagagggggataacattcggaaacggatgctaataccgcatagtttcaggaatcgcatgattcttgaaggaaaggtggcttcggctaccactaatggatggacccgcggcgtattatctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttaaagaagaacaaggatgagagtaactgctcatcccctgacggtatttaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacggggacccgcacaagcggtggagcatgtggtttaatttggaagcaacgcgaagaaccttaccaggtcttgacatccttttgaccacttctagagatagagcttttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagaacgccgcggtgaatacgttcccgggtcttgtacacaccgcccgtcacaccacgagagtttgtaacacccgaagccggtgaggtaaccttttaggagccagccgtctaaggtgggatagataattggggtgaagtcgtaacaaggtagccgtatcggaaggtgcggctggatcacct

SEQ ID NO: 494 - DNA, 1497 bp, Catabacter hongkongensis
agagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaataccgcataagaccacgaaaccgcatggtttagaggtaaaaggattcattcgatgcaggatgagctcgcgtcccattagatagttggtgaggtaacggcccaccaagtcaacgatgggtagccgacctgagagggtgatcggccacattggaactgagaaacggtccaaactcctacgggaggcagcagtggggaatattgggcaatgggggaaaccctgacccagcaacgccgcgtgaaggaagaaggccttcgggttgtaaacttttgtcctatgggacgaaaaaaatgacggtaccataggaggaagctccggctaactacgtgccagcagccgcggtaatacgtagggagcaagcgttgtccggaattactgggcgtaaagggtgcgtaggtggccatgtaagtcaggtgtgaaagaccggggctcaaccccggggttgcacttgaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggggcgatagtcctccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatatagagatatatgttcccttcggggcagagagacaggtggtgcatggttgtcgtcagctcgtgtcgtgagatgttgggttaagtcccgcaacgagcgcaacccttgttgctagttgccagcacgtaaaggtgggaactctagtgagactgccggggacaactcggaggaaggtggggacgacgtcaaatcatcatgccccttatgtcttgggctacacacgtgctacaatggccggtacaaagggcagcgacctcgtaagagtaagcgaatctcaaaaagccggccccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtaacc

SEQ ID NO: 495 - DNA, 1485 bp, Catenibacterium mitsuokai
agagtttgatcctggctcaggatgaacgctggcgccgtgcctaatacatgcaagtcgaacgaatctccttcggaagataagtgcgaacgggtgagtaatacataggtaacctgcccctgtgcgggggataacaggaggaaactcctgctaataccgcatagccatgagcaccgcatggagctcatgccaaatatccttcacgggatagcgcagggatggacctatggcgcattagctagttggcggggcaacggcccaccaaggcaacgatgcgtagccggcctgagagggcggacggccacattgggactgagacacggcccagactctacgggaggcagcagtagggaattttcggcaatgggggaaaccctgaccgagcaacgccgcgtgagcgaagaaggcttcgggtcgtaaagctctgttgtaaaggaagaacgtcggacacaggaaatggtgtgcgagtgacggtactttaccagaaagccacggctaactacgtgccagcagccgcggtaatccgtaggtgccgaccgttatccggaatcattggccgtaaagagggagcaggcggccgcaagggtctgtggtgaaagaccgaagctaaacttcggtaagccatggaaaccgggcggctagagtgcggaagaggatcgtggaattccatgtgtagcggtgaaatgcgtagatatatggaggaacaccagtggcgaagcgacggtctgggccgcaactgacgctcattcccgaaaccgtggggagccaatggcattagataccctagtagtccacgccgtaaacgatggtcactaagtgtcgggggtcaaaccccggtgctgcagtcaacgcaataagtgacccgcctgagtagtacgttcgcaagaatgaaactcaaaggaattgacgggggcccgcacaagcggtggagcatgtggtttaattcgaagcaacgcgaagaaccttaccaggtcttgacatcgatctaaaagggatggagacatcctcatagctatagagaagacaggtggtgcatggttgtcgtcagctcgtgtcgtgagatgttgggttaagtcccgcaacgagcgcaacccctgtcgccagttaccatcattgagttggggactctggcgagactgcctctgcaaggaggaggaaggcggggatgacgtcaaatcatcatgccccttatgacctgggccacacacgtgctacaatggacgggacagagggaagcgaaggcgcgagcgcaagcggaccccagaaacccgttcccagttcggactgcagtctgcaactcgactgcacgaagccggaatcgctagtaatcgcggatcagcatgccgcggtgaatacgttctcgggccttgtacacaccgccgtcacaccatgagagttggcaacacccgaaggcggcggcccaacccgcaaggagggagctgtctaaggtggggctgatgattggggtgaagtcgtaacaaggtaacc

SEQ ID NO: 496 - DNA, 1292 bp, Catonella genomosp. P1 oral clone MB5_P12
gatgaacgctggcggcgtgcctaacacatgcaagtcgaacgagtggcggacgggtgagtaacgcgtgggcaacctgccctatacagggggatagcagctggaaacggctggtaagaccgcataaggaaatcaggtataggatggacccgcgtccgattagccagttggcagggtaaaagcctaccaaagcgacgatcggtagccggactgagaggtcgggcggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcaggcggttttgcaagttgagagtggaagcagggggctcaaccccctgactgctcccaaaactgtaaaacttgagtatgggagaggcaggcggaattcctagtgtagcggtgaaatgcttagatattaggaagaacaccggtggcgaaggcggcctgctggaccaactgacgctgaggctcgaaagcgtgggtagcaaacaggattagataccctggtagtccacgctgtaaacgatgaatactaggtgctgggatttcggtgccgtcgcaaacgcattaagtattccacctggggagtacgttcgcgagaatgaagctcaagggaattgacggggacccgcacaagcggtggagcatgtggtttaattcgacgcaacgcgaagaaccttacccggtcttgagatcgacaggtggtgcatggttgtcgtcagctcgtgtcgtgagatgttgggttaagtcccgcaacgagcgcaacccctatttttagtagccagcggccgggcactctaaagagactgccgaggataactcggaggaaggcggggatgacgtcaaatcatcatgccccttatgaccggggctacacacgtgctacaatgtcagtcagagggaagcgaaggcgtgagtcggagcaaatctcaggctgcctcagttcggatgtagtctgcaactcgactacagaagctggaatcgctagtaatcgcaaatcagaatgttgcggtgaatacgttcccgggtcttgtacacaccgcccgtcacaccatgggagtcggaaatgcccgaagtcagtgcctaaggagctgccgaaggcaggtctggtgactg

SEQ ID NO: 497 - DNA, 1553 bp, Catonella morbi
atgagagtttgatcctggctcaggacgaacgctggcggcgtgcctaatacatgcaagtcgaacgaaccgcgactgagtgcttgcacttggtcaaggtgagtggcgaacgggtgagtaacacgtgggtaacctacctcatagtgggggataacagtcggaaacgactgctaataccgcataggacatgggatcacatgattctgtgaggaaaggtggcgcaagctatcgctaagagatggacccgcggtgcattagctagttggtagggtaagggcctaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggtcttcggatcgtaaagctctgttgttagagaagaacagcgcatagagtaactgctatgcgtgtgacggtatctaaccagaaagccacggctaactacgtgccagcagccgcggtaatacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggaggggttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatcccgacgaccgctctagagatagagtttttcttcggaacgtcggtgacaggtggtgcatggttgtcgtcagctcgtgtcgtgagatgttgggttaagtcccgcaacgagcgcaacccctataactagttgccagcattgagatggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccttttaggagggagccgtcgaaggtgggatagatgattggggtgaagtcgtaacaaggtagccgtatcggaaggtgcggctggatcacctcctttct

SEQ ID NO: 498 - DNA, 1366 bp, Catonella sp. oral clone FL037
gagtttgatcctggctcaggatgaacgctggcggcgtgcctaacacatgcaagtcgaacgagtggcggacgggtgagtaacgcgtgggtaacctgccccgtacagggggatagcgtcgggaaactgacggtaagaccgcatagggaaaactggtatgggatggacccgcgtccgattagccagttggcagggtaaaggcctaccaaagcttcgatcggtagccggactgagaggtcggacggccacattgggactgagacacggcccagactcctacgggaggcagcagtgggggatattgcacaatggaggaaactctgatgcagcgacgccgcgtgagtgaagaagtgctccggcatgtaaagctctttcagcagggaagatgacggtacctgaataagaagccccggctaactacgtgccagcagccgcggtaatacgtagggggcaagcgttatccggatttactgggtgtaaagggagcgcaggcggtctggcaagttgagagtggaagcagggggctcaaccccctgactgctcccaaaactgttggactggagtatgggagaggcaggcggaattcctagtgtagcggtgaaatgctcagatattaggaagaacaccggtggcgaaggcggcctgctggaccaactgacgctgaggctcgagagcgtggggagcgaacaggattagataccctggtagtccacgccgtaaacgatgaatactaggtgccgggatttcggtgccgtcgcaaacgcattgagtattccacctggggagtacgttcgcaagaatgaaactcaaaggaattgacggggacccgcgcaagcggtggagcatgtggtttaattcgaagcaacgcgaagaaccttacccggtcttgagatcgacaggtggtgcatggttgtcgtcagctcgtgtcgtgagatgttgggttaagtcccgcaacgagcgcaacccctgttcttagtagccagcggccgggcactctaaggagactgccggggataacccggaggaaggcggggatgacgtcaaatcatcatgccccttatgacttgggcgacacacgtgctacaatggcgtacaaagggaagcgagctcgtgagagtaagcgaaactcaaaacgtctcagttcggatgtagtctgcaacccgactacagaagctggaatcgctagtaatcgcagatcagcatgctgcggtgaatacgttcccgggtcttgtacacaccgcccgtcacaccatgggagtcggtaatgcccgaagccagtaaccagggagctgtcgaaggcaggactgataactggggtgaagtcgtaacaaggtagccgtatcggaaggtgcggctggaacacctcctt

SEQ ID NO: 499 - DNA, 1403 bp, Cedecea davisae
cggacgggtgagtaatgtctggggatctgcctgatggagggggataactactggaaacggtagctaataccgcataacgtcgcaagaccaaagagggggaccttcgggcctcttgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataacctyrgtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaccaaggtaa

SEQ ID NO: 500 - DNA, 1444 bp, Cellulosimicrobium funkei
gacgaacgctggcggcgtgcttaacacatgcaagtcgaacgatgatgcccagcttgctgggtggattagtggcgaacgggtgagtaacacgtgagtaacctgcccttgacttcgggataactccgggaaaccggggctaataccggatatgagccgccytcgcatgggggtggttggaaagtttttcggtcagggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacgggaagccaccagagatggtggtctctttggacactcgtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagcccatggcccaaccgttcgcggggggagtggtcgaaggtgggactggcgattgggact

SEQ ID NO: 501 - DNA, 1470 bp, Cetobacterium somerae
agagtttgatcctggctcaggatgaacgctgacagaatgcttaacacatgcaagtcgattcgatttaccttcgggtattgaggatggcggacgggtgagtaacgcgtaaggaacttgcctcttggtctgggacaactgttggaaacgacagctaataccggatattatgagattctcgcatgggaaacttatgaaagctatatgcgccaagagagagccttgcgttccattagctagttggtggggtaacggcccaccaaggcgacgatggatagccggcctgagagggtgaacggccacaaggggactgagacacggcccttactcctacgggaggcagcagtggggaatattggacaatgggccacaagcctgatccagcaattctgtgtgcacgatgaaggtcttcggattgtaaagtgctttcagttgggaagaagaaagtgacggtaccaacagaagaagcgacggctaaatacgtgccagcagccgcggtaatacgtatgtcgcaagcgttatccggatttattgggcgtaaagcgcgtctaggcggaaaaataagtctgatgttaaaatgcggggctcaactccgtattgcgttggaaactgtttttctagagtactggagaggtgggcggaactacaagtgtagaggtgaaattcgtagatatttgtaggaatgccgatggagaagtcagctcactggacagatactgacgctaaagcgcgaaagcgtggggagcaaacaggattagataccctggtagtccacgccgtaaacgatgatcactaggtgttgggggtcgaacctcagcgcccaagctaacgcgataagtgatccgcctggggagtacgcacgcaagtgtgaaactcaaaggaattgacggggacccgcacaagcggtggagcatgtggtttaattcgacgcaacgcgagaaaccttaccagcgtttgacatcctaagaagtttccagagatggattcgtgccggcttgccggaacttagtgacaggtggtgcatggctgtcgtcagctcgtgtcgtgagatgttgggttaagtcccgcaacgagcgcaacccctattgtatgttgctaccattaagttgagcactcatgcgatactgcctgcgatgagcaggaggaaggtggggatgacgtcaagtcatcatgccccttatacgctgggctacacacgtgctacaatgggcagtacagagagttgccaacccgcgagggtgagctaatctcttaaagctgttcttagttcggattgtactctgcaactcgagtacatgaagttggaatcgctagtaatcgcaaatcagcatgttgcggtgaatacgttctcgggtcttgtacacaccgcccgtcacaccacgagagttggttgcacctgaagtagcaggcctaaccgtaaggagggatgttcctaaggtgtgattagcgattggggtgaagtcgtaacaaggt

SEQ ID NO: 502 - DNA, 1549 bp, Chlamydia muridarum
ctgagaatttgatcttggttcagattgaacgctggcggcgtggatgaggcatgcaagtcgaacggaacaattgcttcggtgattgtttagtggcggaagggttagtaatgcatagataatttgtccttaacttgggaataacggttggaaacggccgctaataccgaatgtggcgtagattaggcatctaaattacgttaaagaaggggatcttcggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaagacggttaatacccgttggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaatctcggggctcaaccccgaatcggcatctaaaactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgcatatgaccgcggcagaaatgtcgttttccgcaaggacatatgcacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgcgagatggagcaaatcctcaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcaagggggagaggcgcccaaggtgaggctgatgactgggatgaagtcgtaacaaggtagccctaccggaaggtggggctggatcacctccttt

SEQ ID NO: 503 - DNA, 1553 bp, Chlamydia psittaci
ttttctgagaatttgatcttggttcagattgaacgctggcggcgtggatgaggcatgcaagtcgaacggaataatgacttcggttgttatttagtggcggaagggttagtaatacatagataatctgtcctcaacttgggaataacggttggaaacgaccgctaataccgaatgtggtatgtttaggcatctaaaacatattaaagaaggggatcttcggacctttcggttgagggagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacagatacacaggtgctgcatggctgtcgtcagctcgtgccgtgaggtgttgggttaagtcccgcaacgagcgcaacccttatcgttagttgccaacacttagggtgggaactctaacgagactgcctgggttaaccaggaggaaggcgaggatgacgtcaagtcagcatggcccttatgcccagggctacacacgtgctacaatggccagtacagaaggtagcaatatcgtgagatggagcaaatcctcaaagctggccccagttcggattgtagtctgcaactcgactacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctcctttt

SEQ ID NO: 504 - DNA, 1554 bp, Chlamydia trachomatis
ttttctgagaatttgatcttggttcagattgaacgctggcggcgtggatgaggcatgcaagtcgaacggagcaattgtttcggcaattgtttagtggcggaagggttagtaatgcatagataatttgtccttaacttgggaataacggttggaaacggccgctaataccgaatgtggcgatatttgggcatccgagtaacgttaaagaaggggatcttaggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaaggcggttaatacccgctggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaagatcggggctcaaccccgagtcggcatctaatactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgtatatgaccgcggcagaaatgtcgttttccgcaaggacatatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgtgagatggagcaaatcctcaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcaagggagagaggcgcccaaggtgaggctgatgactaggatgaagtcgtaacaaggtagccctaccggaaggtggggctggatcacctcctttt

SEQ ID NO: 505 - DNA, 1407 bp, Chlamydiales bacterium NS11
ggtatgggggcaactccatatagtggcgcaagggttagtaatacatagataatctgcctctgacctgggaataacggctggaaacggccatacatagataatctacctctgacctgggaataacggctggaaacggccgctaataccgaatgaggtggcataaggcatcttgtgcttatcaatgcgggggatcgaaagacctcgtggttagagaagagtctatgggatatcagctagttggtgaggtaatggctcaccaaggctaagacgtctaggcggattgagagattgaccgccaacactgggactgagacactgcccagactcctacgggaggctgcagtcgagaatctttcgcaatgggcgcaagcctgacgaagcgacgccgtgtgagcgaagaaggccttcgggttgtaaagctctttcgctagggaacaagagatataggacaataccctatagatttgatggtacttggtaaagaagcaccggctaactccgtgccagcagctgcggtaatacggagggtgcaagcattgatcggaattactgggcgtaaagggcgcgtaggcggcagaataagtcagatgtgaaattccggggctcaaccccggagctgcatttgaaactattcaactagaggacagttagggtaaacggaattccacgtgtagcggtgaaatgcgtagatatgtggaagaacaccggtggtgaagacggtttactgggctgatactgacgctgaggcgcgaaagcatggggagcaaacaggattagataccctggtagtcctagccttaaacgatgtatactaggagtaggtgggctcaacccccactgtaccggagctaacgcattaagtatgccgcctggggagtacgctcgcaagggtgaaactcaaaagaattgacgggggcccgcacaagcagtggagcatgtggtttaattcgatgcaacgcgaagaaccttacctaggctcgaaatgtagaggacgatatcagagatgatatttcccgaaagggtctctatataggtgctgcatggctgtcgtcagctcgtgccgtgaggtgtttggttaagtccagcaacgagcgcaacccttatcgttagttgccaacacgtaaaggcgggaactctaacgagactgcctgggttaaccaggaggaaggtgaggatgacgtcaagtccgcatggcctttatgtccagggctacacacgtgctacaatggtcggtacagaaggcagcgaaaccgcaaggcgaagcaaatccggaaaaaccgatctcagttcagattgtagtctcaactcggctacatgaagttggaattgctagtaatggcgtgtcagcaacaacgccgtgaatacgttcccgggccttgtacacactgcccgtcacatcatgggagt

SEQ ID NO: 506 - DNA, 1334 bp, Chlamydiales bacterium NS13
tagtggcgcaagggttagtaatacatggataatccacctctcacgtaggaataacggctggaaacggccgctaataccgaatgaggtggcttaaggcatcttaccatagtcaaagcgggggatcgaaagacctcgcggttagagaggagttcatgagatatcagctagttggtgaggtaatggctcaccaaggctaagacgtctaggcggattgagagattgaccgccaacactgggactgagacactgcccagactcctacgggaggctgcagtcgagaatcttgcgcaatgggcgcaagcctgacgaagcgacgccgtgtgagcgaagaaggccttcaggttgtaaagctctttcgctagggaacaagagagtcgggataataatcagatgacttgatggtacttggtaaagaagcaccggctaactccgtgccagcagctgccgtactaccgagggtgcaagcattgatcggaattactgcgcgtaaagggcgcgtacgccgcaggataagtcagatgtgaaattccggggctcaaccccggagctgcatttgaaactctcttgctagaggacagttagggtaaacggaattccacgtgtagcggtgaaatgcgtagatatgtggaagaacaccagtggtgaagacggttttctgggctggaactgacgctgaggcgcgggagctaggggagcaaacaggattagataccctggtagtcctagccgtaaacgatgcatactggatgtagggaggctcaacccttattgtatcggagctaacgcgttaagtatgccgcctggggagtacgcccgcaagggtgaaactcaaaagaattgacgggggcccgcacaagcagtggagcatgtggtttaattcgatgcaacgcgaagaaccttacccaggctcgaagtgtagagaacaagcgcagagatgcggtgtctcttcgggacatctatataggtgctgcatggctgtcgtcagctcgtgccgtgaggtgttgggttaagtcccgcaacgagcgcaacccttattgtcagttgccaacgcgtaaaggcggggactctggcaagactgcctaggttaactaggaggaaggtgaggatgacgtcaagtccgcatggcccttatgtccggggctacacacgtgctacaatggtcgatacagagggctgcgaagccgcgaggcggagcaaatccgataaaaccgatctcagttcagattgcagtctcaactcgactacatgaagttggaattcctagtaaaggcgtgtcagctacagcgccgtgaatacgttcccgggccttgtagacaccgcccgtcacatcatgg

SEQ ID NO: 507 - DNA, 1337 bp, Chlamydiales bacterium NS16
tagtggcggaagggttagtaatacatgagtaacctacctctaacctggggataacggttggaaacggccgctaataccgaatgaggagacgaggggaatgctcatggcttcaaagtaggggatcttgaagggaccttgcggtaggagagaggggtatgggatatcagctagttggtgtggtaaaggcgcaccaaggctaagacgtctaggcggattgagaggttgaccgccaacactgggactgagacactgcccagactcctacgggaggctgcagtcgagaatctttcgcaatgggcgaaagcgtgacgaagcgacgccgtgtggacgatgaaggccttcgggttgtaaagtcctttcgccagggaacaagaaaaattaactaataacttatcaatttgagcgtactaggtaaagaagcaccggctaactccgtgccagcagctgcggtaatacggagggtgcaagcattaatcggatttattgggcgtaaagagcgcgtaggcgggcaagcaagtcagatgtgaaattccggagctcaactccggagctgcatttgaaactacttgtctagaggatggacggagaaaacggaattccacgtgtagcggtgaaatgcgtagatatgtggaagaacaccggtggcgaaggcggttttctagtttattcctgacgctgaggcgcgagagcaaggggagcaaacagggttagataccctggtagtccttgccgtaaacgttgcatacttgatgtatttgggctcaaccccgactgtgtcgaacctaacgcgataagtataccacctgaggagtacgctcgcaagggtgaaactcaaaagaattgacgggggcccgcacaagcagtggagcatgtggtttaattcgatgcaacgcgaagaaccttacccaggcttgacatatagaagaccacatcagaaatgttgtctcccgcaagggcttttgtacaggtgctgcatggctgtcgtcagctcgtgccgtgaggtgttgggttaagtcccgcaacgagcgcaacccttgtcattagttgccaacatttcgtgatggggactctaatgagactgcctgggttaactaggaggaaggtgaggatgacgtcaagtccgcatggcctttatgtctggggctacacacgtgctacaatggtcgatacagaaggcagcgaagccgcaaggtggagcaaatcctcaaaaccgatctcagttcggatagaagtctgcaactcgacttcttgaagttggaattgctagtaatgacgtgtcagcaataacgtcgtgaatacgttcccgggccttgtacacaccgcccgtcacatcacgg

SEQ ID NO: 508 - DNA, 1548 bp, Chlamydophila pecorum
ctgagaatttgatcttggttcagattgaacgctggcggcgtggatgaggcatgcaagtcgaacggaataatggcttcggctattatttagtggcggaagggttagtaatacatagataatttgtcttaacttgggaataacggttggaaacggccgctaataccgaatgtggtgtgtttaggcatctaaattacattaaagaaggggatcttcggacctttcggttaagagaaagtctgtgggatatcagcttgttggtggggtaatggcctaccaaggctatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggctctagggttgtaaagcactttcgcctgggaataagagagattggctaatatccaattgatttgagcgtaccaggtaaagaagcaccggctaactccgtgccagcagctgcggtaatacggagggtgctagcgttaatcggatttattgggcgtaaagggcgtgtaggcggaaaggaaagttagatgtcaaatcttgaggctcaacctcaagtcggcatctaatactatctttctagaggttggatggagaaaagggaattccacgtgtagcggtgaaatgcgtagatatgtggaagaacaccagtggcgaaggcgcttttctaatttttcctgacgctaaggcgcgaaagcaaggggagcaaacaggattagataccctggtagtccttgctgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgtaaggacagatacacaggtgctgcatggctgtcgtcagctcgtgccgtgaggtgttgggttaagtcccgcaacgagcgcaacccttatcgttagttgccagcactttgggtgggaactctaacgagactgcctgggttaaccaggaggaaggcgaggatgacgtcaagtcagcatggcccttatgtccagggcgacacacgtgctacaatgggtagtacagaaggtagcaagatcgtgagatggagcaaatccttaaagctatcctcagttcggattgtagtctgcaactcggctacatgaagtcggaattgctagtaatggcgtgtcagccataacgccgtgaatacgttcccgggccttgtacacaccgcccgtcacatcatgggagttggtttcaccttaagtcgttgactcaacctatttttaggagggaggcgcccaaggtgaggctgatgactgggatgaagtcgtaacaaggtagccctaccggaaggtggggctggatcacctccttt

SEQ ID NO: 509 - DNA, 1552 bp, Chlamydophila pneumoniae
ctgagaatttgatcttagttcagattgaacgctggcggcgtggatgaggcatgcaagtcgaacggaataatgacttcggttgttatttagtggcggaagggttagtagtacatagataatctgccctcaacttggggataacggttggaaacgatcgctaataccgaatgtagtgtaattaggcatctaatatatattaaagaaggggatcttcggacctttcggttgaggaagagtttatgcgatatcagcttgttggtggggtaaaagcccaccaaggcgatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggggaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacaactgtagaaatacagctttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctagccccagttcggattgtagtctgcaactcgactacatgaagtcggaattgctagtaatggcgtgtcagccataacgccgtgaatacgttctcgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctccttttt

SEQ ID NO: 510 - DNA, 1548 bp, Chlamydophila psittaci
ctgagaatttgatcttggttcagattgaacgctggcggcgtggatgaggcatgcaagtcgaacggaataatgacttcggttgttatttagtggcggaagggttagtaatacatagataatctgtcctcaacttgggaataacggttggaaacgaccgctaataccgaatgtggtatgtttaggcatctaaagcatattaaagaaggggatcttcggacctttcggttgagggagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacagatacacaggtgctgcatggctgtcgtcagctcgtgccgtgaggtgttgggttaagtcccgcaacgagcgcaacccttatcgttagttgccaacacttagggtgggaactctaacgagactgcctgggttaatcaggaggaaggcgaggatgacgtcaagtcagcatggcccttatgcccagggctacacacgtgctacaatggccagtacagaaggtagcaatatcgtgagatggagcaaatcctcaaagctggccccagttcggattgtagtctgcaactcgactacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctccttt

SEQ ID NO: 511 - DNA, 1419 bp, Chloroflexi genomosp. P1
gatgaacgctggcggcgtgcttaatacatgcaagtcgaacgggtgcagcgatgtaccagtggcgaacgggtgagtaacacgttggtgacctgccccaaagaggggaataccgcttggaaacgagcgacaaaaccgcataagctatcgggagtcagagagccgatagtaaaagaggaatctactttgggaggggcctgcggcccatcagctagttggagaggtaacggctcaccaaggcgaagacgggtaggggacctgagagggtgatcccccacaatggaactgaaacacggtccatacacctacgggtggcagcagtagggaatattgctaaatgggcgaaagcctgaagcagcaacgccgcgtgaacgaagaaggccttcgggtcgtaaagttcttttacgtgggaagaggaaggacagtaccacgggaataagtctcggctaactacgtgccagcagccgcggtaaaacgtaggaggcgagcgttatccggatttactgggcgtaaagagcgtgtaggaggcaaaacaagacggatgtgaaagcccccggcttaaccgggggaggtcgtacgtgactgtagagctagagtgagttagaggtaagcggaactccgggagtagtggtgaaatgcgtagatatccggaagaacatcagaggcgaaagcggcttactgggacttaactgacactgagacgcgaaagccagggtagcaaacgggattagagaccccggtagtcctggctgtaaacgatgtagactggacgttttcggggtaaaagctgagagtgtcgaagcgaacgcgataagtctaccgcctggggagtacggtcgcaggattaaaactcaaaggaattgacgggggcccgcacaagcagcggagcgtgtggtttaattcgatgatacacgaagaaccttaccggggtttgacatacaggtagtaagaaggcgaaagccggatgacccttacgggggagcctgaacaggtgctgcatggctgtcgtcagctcgtgtcgtgagatgttcggttaagtccgctaacgagcgcaacccttgtcgcgtgttacaagtgtcacgcgagaccgccggtagaaagccggaggaaggtggggatgacgtcaagtcagcatggcctttatatcccgggctacacacacgctacaatggccggtacagagggtagcgaagccgcgaggcggagccaatcctgaaaagccggtcgtagttcagattgcaggctgcaactcgcctgcatgaagatggagttgctagtaaccgtaggtcagcgatactacggtgaatacgttcccgggccttgtacacaccgcccgtcacgtcatgggagttggcaacacctgaagccggtatcctgaccgagaggagggagccgtcaaaggtggggttgatgattggggtg

SEQ ID NO: 512 - DNA, 1334 bp, Christensenella minuta
ggctcaggacgaacgctggcggcgtgcttaacacatgcaagtcgaacgagtggcggacgggtgagtaacgcgtgagcaacctgccctgcaacgggggacaacagttggaaacgactgctaataccgcatgagaaaagtcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgatgacggtaccataggaggaagctccggctaactacgtgccagcagccgcggtaatacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgactgacactgaggcacgaaagcgtggggagcaaacaggattagataccctggtagtccacgccgtaaacgatggatactaggtgtggggcgttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcgacaggtggtgcatggttgtcgtcagctcgtgtcgtgagatgttgggttaagtcccgcaacgagcgcaacccttattgctagttgccagcgcgcgggaactctagtgagactgccggggacaactcggaggaaggtggggacgacgtcaaatcatcatgccccttatgtcttgggctacacacgtgctacaatggccggcaaagggcagcgaacccgtaaggggaagcgaatctcaaccggtcccagttcggatgtgggctgcaacccgcccacagaagtcggagttgctagtaatcgcgaatcagcatgtcgcggtgaatgcgttcccgggccttgtacacaccgcccgtcacaccacggaagttgggagcacccgaagccagtgcttagagagctgtcgaaggtgagatcaatgactggggtgaagtcgtaacaaggtagccgtatcggaagg

SEQ ID NO: 513 - DNA, 1544 bp, Chromobacterium violaceum
tgaactgaagagtttgatcctggctcagattgaacgctggcggcatgctttacacatgcaagtcgaacggtaacagggtgcttgcaccgctgacgagtggcgaacgggtgagtaatgcgtcggaatgtaccgtgtaatgggggatagctcggcgaaagccggattaataccgcatacgccctgagggggaaagcgggggatcgaaagacctcgcgttatacgagcagccgacgtctgattagctagttggtgaggtaagagctcaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaggaaatcccgctggttaatacccggcggggatgacagtacctgaagaataagcaccggctaactacgtgccagcagccgcggtaatacgtagggtgcgagcgttaatcggaattactgggcgtaaagcgtgcgcaggcggttgtgcaagtctgatgtgaaagccccgggcttaacctgggaacggcattggagactgcacagctagagtgcgtcagaggggggtagaattccacgtgtagcagtgaaatgcgtagagatgtggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgtagctaacgcgtgaagttgaccgcctggggagtacggccgcaaggttaaaactcaaaggaattgacggggacccgcacaagcggtggatgatgtggattaattcgatgcaacgcgaaaaaccttacctgctcttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaaaccggaggaaggtggggatgacgtcaagtcctcatggcccttatgagcagggcttcacacgtcatacaatggtcggtacagagggttgccaagccgcgaggtggagctaatctcagaaaaccgatcgtagtccggatcgcactctgcaactcgagtgcgtgaagtcggaatcgctagtaatcgcagatcagcatgctgcggtgaatacgttcccgggtcttgtacacaccgcccgtcacaccatgggagtgagtttcaccagaagtgggtaggctaaccgcaaggaggccgcttaccacggtgggattcatgactggggtgaagtcgtaacaaggtagccgtaggggaacctgcggctggatcacctcctttctagaga

SEQ ID NO: 514 - DNA, 1480 bp, Chryseobacterium anthropi
ctagagtttgatcctggctcaggatgaacgctagcgggaggcctaacacatgcaagccgagcggtagagtttcttcggaaacttgagagcggcgcacgggtgcgtaacacgtgtgcaacctacctttatctgggggatagcctttcgaaaggaagattaataccccataatataatgattggcatcaattattattgaaaactccggtggatagagatgggcacgcgcaagattagatagttggtgaggtaacggctcaccaagtcaatgatctttaggggtcctgagagggagatcccccacactggtactgagacacggaccagactcctacgggaggcagcagtgaggaatattggacaatgggtgagagcctgatccagccatcccgcgtgaaggawgacggtcctatggattgtaaacttcttttgtacagggataaacctactctcgtgagggtagctgaaggtactgtacgaataagcaccggctaactccgtgccagcagccgcggtaatacggagggtgcaagcgttatccggatttattgggtttaaagggtccgtaggcggacttgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgatggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaattgacaggtctagaaatagaccctccttcgggcaatttccaaggtgctgcatggttgtcgtcagctcgtgccgtgaggtgttaggttaagtcctgcaacgagcgcaacccctgtcactagttgcyawcattyagttgrggactctagtgagactgcctacgcaagtagagaggaaggtggggatgacgtcaaatcatcacggcccttacgtcttgggccacacacgtaatacaatggccggtacagagggcagctaccaggtgactggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtagcc

SEQ ID NO: 515 - DNA, 1519 bp, Chryseobacterium gleum
atacaatggagagtttgatcctggctcaggatgaacgctagcgggaggcctaacacatgcaagctgagcggtagagatctttcgggatcttgagagcggcgtacgggtgcggaacacgtgtgcaacctgcctttatcagggggatagcctttcgaaaggaagattaataccccataatatattgagtggcatcacttaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggctttcgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattt

SEQ ID NO: 516 - DNA, 1483 bp, Chryseobacterium hominis
tttgatccctggctcaggatgaacgctagcgggaggcctaacacatgcaagccgagcggtatttgttcttcggaacagagagagcggcgcacgggtgcggaacacgtgtgcaacctgcctttatctgggggatagcctttcgaaaggaagattaataccccataatatattgagtggcatcatttgatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaatttgaagtggctggaataagtagtgtagcggtgaaatgcatagatattacttagaacaccaattgcgaaggcaggtcactaagatttaactgacgctgatggacgaaagcgtggggagcgaacaggattagataccctggtagtccacgccgtaaacgatgctaactcgtttttggggyttcggcttcagagactaagcgaaagtgataagttagccacctggggagtacgttcgcaagaatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctagcattaagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtagccgtacccga

SEQ ID NO: 517 - DNA, 1399 bp, Citrobacter amalonaticus
  modified_base (915)..(915): a, c, t, g, unknown or other
tcgacggtaacaggaagcagcttgctgctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggttaaggttaataaccttagccattgacgttacccgcagaagaagcaccggctaactccgtgccagcagccgcggtaatacggagggtgcaagcgttaatggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggtgtggcttccggagctaacgcgttaaatagaccgcctggggagtacggccgcaaggttaaaactcaaatgaattgaagggggcccgcacaagcggtggagcatgtggtttaattcgatgcaagcgttaatnggatacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgc

SEQ ID NO: 518 - DNA, 1396 bp, Citrobacter braakii
  modified_base (940)..(940): a, c, t, g, unknown or other
  modified_base (976)..(976): a, c, t, g, unknown or other
tcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcaacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccanggaacttaccagagatggtttggtgccttcgggaancgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggag

SEQ ID NO: 519 - DNA, 1393 bp, Citrobacter farmeri
  modified_base (951)..(951): a, c, t, g, unknown or other
  modified_base (1369)..(1370): a, c, t, g, unknown or other
aacaggaagcagcttgctgctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggatgtggttaataaccgcattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttgtcagagatgccnaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagnntagcttaaccttcgggagggcgc

SEQ ID NO: 520 - DNA, 1398 bp, Citrobacter freundii
  modified_base (19)..(19): a, c, t, g, unknown or other
  modified_base (1376)..(1381): a, c, t, g, unknown or other
tcgaacggtagcacagagngagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgaggttaataacctcagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagnnnnnngcttaaccttcgggagg

SEQ ID NO: 521 - DNA, 1397 bp, Citrobacter gillenii
gtcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggggatgtggttaataaccgcattcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagatatgctttagtgccttcgggaaccgtgagacaggtgctgcatggctgtcgtcagctcgagttgcgaagagttgggtaagaacccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggag

SEQ ID NO: 522 - DNA, 1387 bp, Citrobacter koseri
acaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaaaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcattgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgacttagatgcgtaaggcacgggctcaaccgtgctgcatggctgtcgtcagctcgtgttgtgaaatgtagaggggggtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctccgggagggc

SEQ ID NO: 523 - DNA, 1394 bp, Citrobacter murliniae
acggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgtggttaataaccgcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagtttgcagagatgcgaacgtgccttcgggagctctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggaggg

SEQ ID NO: 524 - DNA, 1542 bp, Citrobacter rodentium
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccggtggagggggataactactggaaacggtagctaataccgcataacgtcgcaagaccaaagagggggaccttcgggcctcttgccaccggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggattgtggttaataaccgcagtcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagagggggggggaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctacttggaggttgtgcccctgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctcctta

SEQ ID NO: 525 - DNA, 1326 bp, Citrobacter sedlakii
cttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatgcggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtcacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcaca

SEQ ID NO: 526 - DNA, 967 bp, Citrobacter sp. 30_2
  modified_base (8)..(10): a, c, t, g, unknown or other
  modified_base (762)..(762): a, c, t, g, unknown or other
  modified_base (776)..(776): a, c, t, g, unknown or other
  modified_base (926)..(926): a, c, t, g, unknown or other
  modified_base (940)..(940): a, c, t, g, unknown or other
  modified_base (945)..(945): a, c, t, g, unknown or other
gcacagannnagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgaggttaataacctcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggangttgtgcccttgangcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacntccagagaacttancaganatgctttggtgccttcgggaac

SEQ ID NO: 527 - DNA, 1383 bp, Citrobacter sp. KMSI-3
  modified_base (926)..(927): a, c, t, g, unknown or other
  modified_base (934)..(934): a, c, t, g, unknown or other
  modified_base (948)..(948): a, c, t, g, unknown or other
  modified_base (964)..(964): a, c, t, g, unknown or other
  modified_base (1059)..(1059): a, c, t, g, unknown or other
  modified_base (1364)..(1364): a, c, t, g, unknown or other
gcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcacttggaggttgtgcccttgaggcgtggcttccggagctaacgcgttaagtcgaccgcctggggagtacggcgcaaggttaaaactcaaatgaattgacgggggcccgcacaagcggtggagcatgtggtttaattcgatgcaacgcgaagaaccttacctactcttgacatccanngaayttngcagagatgctttngtgccttcgggaactntgagacaggtgctgcatggctgtcgtcagctcgtgttgtgaaatgttgggttaagtcccgcaacgagcgcaacccttatcctttgttgccagcgnttcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagntagcttaaccttcgggagg

SEQ ID NO: 528 - DNA, 1022 bp, Citrobacter werkmanii
  modified_base (13)..(15): a, c, t, g, unknown or other
  modified_base (17)..(17): a, c, t, g, unknown or other
  modified_base (19)..(21): a, c, t, g, unknown or other
  modified_base (30)..(30): a, c, t, g, unknown or other
  modified_base (34)..(34): a, c, t, g, unknown or other
  modified_base (78)..(78): a, c, t, g, unknown or other
gtactttcagcgnnngnannngttgtggtnaatnaccgcagcaattgacgttactcgcagaagaagcaccgggctaantccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcggg

SEQ ID NO: 529 - DNA, 1266 bp, Citrobacter youngae
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcagcgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaagttttcagagatgagaacgtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcg

SEQ ID NO: 530 - DNA, 1436 bp, Cloacibacillus evryensis
cgcgtcgcgacgctggcggcgtgcctaacacatgcaagtcgaacgaagaccatagaggagcttgcgttaatatggttttagtggcggacgggtgagtaacgcgtgaggacttgtcgagtacagggggacaacaggtggaaacgtctgctaataccccataagccttcgggtaaaaggagcgatccggtacacgagagactcgcgttctatcagctagtaggtggggtaacggcccacccaggccaagacggatagccggactgagaggtcgatcggccacactggaactgagacacggtccagactcctacgggaggcagcagtggggaatattgggcaatgggggaaaccctgacccagcgacgccgcgtgagtgaagaaatccctcgggatgtaaaactctgttgtgtgggaagataatgacggtaccacacgaggaagccccggcaaactacgtgccagcagccgcggtaatacgtagggggcgagcgttgttcggaattactgggcgtaaagcgcacgcaggcggaccagtaagtctgtcgtcaaaggcggaggctcaaccttcgttccacgatagatactgcgggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatactaccggtactgacctgaaagggaagggaccccagcttgctggggaagtagaacaggtgctgcatggctgtcgtcagctcgtgtcgtgagatgttgggttaagtcccgcaacgagcgcaacccctatagccagttgctaacaagtgaagttgagcactctggcgagactgccgccgacaaggcggaggaaggtggggatgacgtcaagtcatcatggcctttatgcccagggcgacacacgtgctacaatggacggcacaaaaggcagcttactagcgatagttggcgaatcctaaaaagccgttcccagttcggattgcagtctgaaacccgactgcatgaagccggaatcgctagtaatcgcagatcagccaagctgcggtgaatacgttcccgggccttgtacacaccgcccgtcacaccacccgagttgggggcacccgaagccgcaggcttaacccgtaagggaaagaagcgtctaaggtgcgccgagtaagg

SEQ ID NO: 531 - DNA, 975 bp, Clostridiaceae bacterium END-2
  modified_base (738)..(738): a, c, t, g, unknown or other
  modified_base (856)..(856): a, c, t, g, unknown or other
  modified_base (917)..(917): a, c, t, g, unknown or other
  modified_base (926)..(926): a, c, t, g, unknown or other
  modified_base (946)..(946): a, c, t, g, unknown or other
  modified_base (952)..(952): a, c, t, g, unknown or other
  modified_base (954)..(954): a, c, t, g, unknown or other
  modified_base (958)..(958): a, c, t, g, unknown or other
  modified_base (967)..(969): a, c, t, g, unknown or other
gattatttcggtaagaagtactttatgactgagtggcggacgggtgagtaacgcgtggataacctgcctcatacagggggataacagttagaaatgactgctaataccgcataagcgcacagtgctgcatggcacagtgcgaaaagctccggcggtatgagatggatccgcgtttgattagctagttggtggggtaaaggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatactangtgtcgggcgccaaaggcgttcggtgccgcagcaaacgcaataagtattccacctggggagtacgttcgcaagaatgaaactcaaaggaattgacggggacccgcacaagcggtggancatgtggtttaattcgaagcaacgcgaagaaccttaccaagtcttgacatctgcctgaccnggtccgtanaggacccttccttcgggacnggcaananaggnggtgcatgnnngtcgtc

SEQ ID NO: 532 - DNA, 990 bp, Clostridiaceae bacterium JC13
  modified_base (896)..(896): a, c, t, g, unknown or other
  modified_base (904)..(904): a, c, t, g, unknown or other
  modified_base (924)..(924): a, c, t, g, unknown or other
  modified_base (934)..(934): a, c, t, g, unknown or other
  modified_base (942)..(942): a, c, t, g, unknown or other
  modified_base (968)..(968): a, c, t, g, unknown or other
  modified_base (970)..(970): a, c, t, g, unknown or other
  modified_base (983)..(984): a, c, t, g, unknown or other
gaagtgaagatagcttgctattggaacttagtggcgaacgggtgagtaacacgtagataacctgcctgtatgaccgggataacagttggaaacgactgctaataccggataggcagagaggaggcatctcttctctgttaaagttgggacacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcnacgcgaanaaccttaccaggccttgacntggtatcaanggccctanagatagggagatagttatggtacacncnggtggtgcatggnngtcgtc

SEQ ID NO: 533 - DNA, 1480 bp, Clostridiales bacterium 9400853
tagagtttgatcctggctcaggatgaacgctggcggcgtgcctaacacatgcaagtcgagcgagaagttactcaatgaatcttcggaagaattgagtaatggaaagcggcggacgggtgagtaacgcgtgggcaacctgcctttcacagagggatagccaaaggaaactttgattaaaacctcataaagccggaatagtgcataatataccggccaaagatttatcggtgaaagatgggcccgcgtctgattagctagttggtggggtaacggctcaccaaggcaacgatcagtagccgacctgagagggtgatcggccacattggaactgagacacggtccaaactcctacgggaggcagcagtggggaatattgcacaatgggcgcaagcttgatgcagcaacgccgcgtgaacgaagaaggccttcgggtcgtaaagttctgtccatagggaagaaacaaatgacggtacctatggaggaagccccggctaaatacgtgccagcagccgcggtaatacgtatggggcaagcgttatccggaattattgggcgtaaagagtgcgtaggtggtggcttaagcgcagggtttaaggcaatggcttaactattgttcgccttgcgaactgggtcacttgagtacaggagaggaaagcggaattcctagtgtagcggtgaaatgcatagatattaggaggaacaccggtggcgaaggcggctttctggactgcaactgacactgaggcacgaaagcgtgggtagcaaacaggattagataccctggtagtccacgccgtaaacgatgagcactaggtgtcggccaataaaggtcggtgccgcagttaacgcattaagtgctccgcctggggagtacgcacgcaagtgtaaaactcaaaggaattgacggggacccgcacaagcagcggagcatgtggtttaattcgaagcaacgcgaagaaccttaccagagcttgacatccctctgacagatccttaatcggattcttcttcggacagaggagacaggtggtgcatggttgtcgtcagctcgtgtcgtgagatgttgggttaagtcccgcaacgagcgcaacccttatcattagttgccatcattaagttgggcactctagtgagactgccggggacaactcggaggaaggtggggatgacgtcaaatcatcatgccccttatgttctgggctacacacgtgctacaatggtcggtacagaaagcagcgaaaccgtgaggtgaagccaatctccaaaaccgatctcagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccgaagttggacaataaatcgtttacctaaggcaaaaccaatgactggggtgaagtcgtaacaaggtagccgta

SEQ ID NO: 534 - DNA, 1489 bp, Clostridiales bacterium 9403326
tagagtttgatcctggctcaggataaacgctggcggcgtgcgtaacacatgcaagtcgaacgagaatgtgctgacggatccttagggtgaagatagcacaggacagtggcggatgggtgagtaacgcgtaagaaacctgcctttcacaccgggatagcagctggaaacggctattaataccggatgacactttttccccgcatgaggaagaggttaaagaatttcggtgaaagatggtcttgcgtctgattagctagttggtggggtaacggcctaccaaggcgacgatcagtagccggcctgagagggtgtacggccacattgggactgagacacggcccaaactcctacgggaggcagcagtggggaattttgcacaatggaggaaactctgatgcagcgacgccgcgtgaacgaagaaggtcttcggattgtaaagttctgtcctgggtgaagataatgacggtaactcaggaggaagccccggctaactacgtgccagcagccgcggtaatacgtagggggcgagcgttgttcggaattattgggcgtaaagggtacgtaggcggtttgttaagtttggcgttaaatcacggggctcaaccccgttcagcgttgaaaactggcaaacttgagtagtagaggggacagtggaattcctagtgtagcggtgaaatgcgtagagattaggaagaataccggtggcgaaggcgactgtctggatacatactgacgctcaggtacgaaagcgtggggagcaaacaggattagataccctggtagtccacgccctaaacgatgagtgctaggtgtcgggtgtcaaagcccggtgccgccgttaacacattaagcactccgcctggggagtacgcacgcaagtgtgaaactcaaaggaattgacggggacccgcacaagtagcggagcatgtggtttaattcgaagcaacgcgaagaaccttaccagggcttgacataacagtgacgggttaagagattaaccgttcccttcggggacactgctacaggtggtgcatggttgtcgtcagctcgtgtcgtgagatgttgggttaagtcccgcaacgagcgcaacccttgtcgttagttgccagcattaagttggggactctagcgagactgccggtgataaaccggaggaaggtggggatgacgtcaaatcatcatgccctttatgtcctgggctacacacgtgctacaatggccgaaaacagcgtgaagcaacctcgtgagagcaagcgaaccacgaaaagtcggtctcagttcggactgtaggctgcaactcgcctacacgaagtcggagttactagtaatcgcgaatcagcatgtcgcggtgaatgcgttcccgggtcttgtacacaccgcccgtcacaccatggaagttggtaatacccgaagccgctgagcgaacctatgacgcaggcgtcgaaggtaggatcaatgactggggtgaagtcgtaacaaggtagccgta

SEQ ID NO: 535 - DNA, 1335 bp, Clostridiales bacterium SY8519
gagtttgatcctggctcaggatgaacgctggcggcgtgcctaacacatgcaagtcgaacgagtggcggacgggtgagtaacgcgtggataacctgcctcaaacagggggataacagccggaaacggctgctaataccgcataagaaaaagtggtttgagatggatccgcgtctgattagttagttggcggggtaacggcccaccaaggcgacgatcagtagccggcctgagagggtgaacggccacattgggactgagacacggcccagactcctacgggaggcagcagtggggaatattgcacaatgggggaaaccctgatgcagcaacgccgcgtgagcgaagaagtatttcggtatgtaaagctctatcagcagggaagatgacggtacctgactaagaagctccggctaaatacgtgccagcagccgcggtaatacgtatggagcaagcgttatccggatttactgggtgtaaagggagcgcaggcggtggcgcaagtctgatgtgaaaacccggggcccaaccccgggactgcattggaaactgcgtgacttgagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgttggcatgtcagtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccttgtgtatagtagccagcggccgggcactctatacagactgccagggacaacctggaggaaggcggggatgacgtcaaatcatcatgccccttatggcctgggcgacacacgtgctacaatggcgtacagagggaggcraagccgcgaggtggagcgaatcccaaaacgtctcagttcggatgcaggctgcaacccgcctgcagaagctggaatcgctagtaatcgcagatcagcatgctgcggtgaatacgttcccgggtcttgtacacaccgcccgtcacaccatgggagtcggaaatgcccgaagccggtacccagggagccgtcgaaggcaggtctgataactggggtgaagtcgtaacaaggtagcc

SEQ ID NO: 536 - DNA, 1319 bp, Clostridiales bacterium oral clone P4PA_66 P1
gacgaacgctggcggcgcgcctaacacatgcaagtcgagcgagcggcggacgggtgagtaacgcgtgagcaacctaccttttacagggggataacgtcccgaaagggaccctaataccgcatgagcaaagccggtaaaagatgggctcgcgtccgattagatagttggtgaggtaacggcccaccaagtcaacgatcggtagccgacctgagagggtgatcggccacattggaactgagacacggtccagactcctacgggaggcagcagtggggaatattgggcaatgggggaaaccctgacccagcgacgccgcgtgaaggaagacggccttcgggttgtaaacttctgttcttggtgaagaagacggtaaccaaggaggaagccccggctaactacgtgccagcagccgcggtaatacgtagggggcgagcgttgtccggaatgattgggcgtaaagggcgcgtaggcggctacggaagtctggagtggaagtcctattttcaaggtaggaattgctttggaaactccgcagcttgagtgcaggagaggttatcggaattcccggtgtagcggtgaaatgcatagagatcgggaggaacaccagtggcgaaggcgggtaactggactgactgacgctgaggcgcgaaagtgtggggagcaaacaggattagataccctggtagtccacactgtaaacgatgaatgctaggtgtaggtgcatctgtgccgtcgtaaacacaataagcattccgcctggggagtacggtcgcaagattaaaactcaaaggaattgacgggggcccgcacaagcagcggagcatgtggtttaattcgaagcaacgcgaagaaccttaccaggtcttgacatcgacaggtggtgcatggatgtcgtcagctcgtgtcgtgagatgttgggttaagtcccgcaacgagcgcaacccttgccaatagttactaacggctgaggactctattgggactgccgtggacaacacggaggaaggtggggacgacgtcaaatcatcatgccccttatgacctgggctacacacgtgctacaatggtcgccaaagaggagcaaagccgcaaggcggagcggatctcaagcgatctcagttcagatgtgggctgcaacccgcccacagaagtcggagttgctagtaatcgcgaatcagcatgtcgcggtgaatacgttcccgggccttgtacacaccgcccgtcacaccatgggagttgatagcgcccgaaggcagaaggtagccatctgacgaaggcgagattaatgactggggtgaagtcgtaacagggtagccgta

SEQ ID NO: 537 - DNA, 1487 bp, Clostridiales bacterium oral taxon 093
gagtttgatcctggctcaggacgaacgctggcggcatgcttaacacatgcaagtcgaacgagctgattccttcgggatgaaagcgagtgcgaacgggtgagtaatgtatgagtaacctgcctctgtctacgggataacatttggaaacaagtgctaatacggtataagaccacagcaccgcatggtgcaggggtaaaagatttatcggacagagatggactcatatcccattagctagttggtgagataatagcccaccaaggcgacgatgggtagccgagctgagaggctgatcggccacattggaactgaaacacggtccagactcctacgggaggcagcagtggggaatattgggcaatggaggaaactctgacccagcaatgccgcgtgagcgatgaaggtcatcgattgtaaagctcttttcctgggaacgaaacaaatgacggtacccagggaataagccccggctaactacgtgccagcagccgcggtaatacgtagggggcgagcgttgtccggaatgactgggcgtaaagggtgcgtaggtggtttaataagttagaagtgtaatacccgggcttaactcgggtgctgcttctaaaactgttaggcttgagtgtagtagaggaaagcggaattcaatgtgtagcggtggaatgcgtagatatattgaagaacatcagtggcgaaggcggctttctggactataactgacactgaggcacgaaagcgtggggagcaaacaggattagataccctagtagtccacgccgtaaacgatggatactagatgcaggaggtattcactccttctgtgtcgcagctaacgcaataagtatcccgcctggggagtacgatcgcaagattaaaactcaaaggaattgacggggacccgcacaagcagcggaacatgtggtttaattcgaagcaacgcgaaaaaccttaccaagacttgacatcagtatgactatcatagaaatatggtatctcgcaagagcatactgacaggtggtgcatggttgtcgtcagctcgtgtcgtgagatgttaggttaagtcctgcaacgagcgcaacccttataactagttgccaatattaagttaggaactctagttagactgccgtggtcaacacggaggaaggtggggatgacgtcaaatcatcatgccccttacgtcttgggctacacacgtgctacaatggctattacaaagagttgcaagttggtaacagcaagctaatctcaaaaaaatagtctcagttcggattgtgggctgcaacccgcccacatgaagtcggagttgctagtaatcccgaatcagcatgtcggggtgaatgcgttcccgggtcttgtacacaccgcccgtcacgccatgggagttggtagtacccaaagtcggtgagctaaccgcaaggaagcagccgcctaaggtaagatcaatgactggggtgaagtcgtaacaaggtagccgtatcggaaggtgc

SEQ ID NO: 538 - DNA, 1532 bp, Clostridiales bacterium oral taxon F32
agagtttgatcctggctcaggataaacgctggcggcgcacataagacatgcaagtcgaacgaaagtcgttgtatatgaaattgactaagaatttagatttatctagaagatgagaatgtagattatacaacaatggctttagtggcggactggtgagtaatacgtaagcaacctgcctattagaggggaataacaattagaaatgattgataataccgcatatgccatagtcatcacatgatgatagtgggaaaggagtaatccgctgatagatgggcttacgcctgattagatagttggtagggtaatggcctaccaagtctgcgatcagtagccgaactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagataaaagacagtacctgtaaaataagctccggctaactacgtgccagcagccgcggtaatacgtagggagcgagcgttatccggatttattgggtgtaaagggtgcgtagacgggaaattaagttatttgtgaaatccctcggcttaaccgaggaactgcaactaaaactgattttcttgagtattggagaggaaagtggaattcctagtgtagcggtgaaatgcgtagatattaggaggaacaccagtggcgaaggcgactttctggacaataactgacgttgaggcacgaaagtgtggggagcaaacaggattagataccctggtagtccacactgtaaacgatggatactaggtgtagggtgtgataaacgctctgtgccgtcgctaacgcagtaagtatcccacctggggagtacgaccgcaaggttgaaactcaaaggaattgacgggggcccgcacaagcagtggagtatgtggtttaattcgacgcaacgcgaagaaccttaccagggcttgacatatacaggaatatgctagagatagtatagctcttcggagcctgtatacaggtggtgcatggttgtcgtcagctcgtgtcgtgagatgttgggttaagtcccgcaacgagcgcaacccctatctttagttaccagcgagtaatgtcgggaactctagagagactgccggtgttaaatcggaggaaggtggggacgacgtcaaatcatcatgccctttatgtcctgggctacacacgtactacaatggctattacaaagggaagcaatacagcaatgtggagcaaaactcaaaaaaatagtctcagttcggattgaaggctgaaattcgccttcatgaagctggaattgctagtaatggcaggtcagcatactgccgtgaatacgttcccgggccttgtacacaccgcccgtcacaccatgagagttggggatacccgaagcctgtgagctaacttttagaggcagcagtcgaaggtagaatcaatgattggggtgaagtcgtaacaaggtagccgt

SEQ ID NO: 539 - DNA, 1474 bp, Clostridiales bacterium ph2
tggctcaggattaacgctggcggcgtgcataacacatgcatgttgaacgagaatctctttgacagatccttcgggtgacgacagagagaggaaagtagcggatgggtgagtaacacgtaaggaacctgccatgcacagggggatagcagccggaaacgactattaataccccatgacacctcactttcgcatgaaagagaggtcaaagatttatcggtgtgtgatggccttgcgtctgattagcttgttggtggggtaaaggcctaccaaggcgatgatcagtagccggcttgagagagtgtacggccacattgggattgagacacggcccagactcctacgggaggcagcagtggggaattttgcacaatggaggaaactctgatgcagcgacgccgcgtgaacgaagaaggtcttcggattgtaaagttctgtcctggacgaagataatgacggtaatccaggaggaagccccggctaactacgtgccagcagccgcggtaatacgtagggggcgagcgttgtccggaatgattgggtgtaaagggtacgcaggcggtctattaagtttgacgtgaaagcccggggctcaacctcggcaagcgttgaaaactggtagacttgaatagtggaagggacagtggaattcctagtgtagcggtgaaatgcgtagagattaggaagaataccaatggcgaaagcaactgtctggacacatattgacgctgaggtacgaaagcgtggggagcaaacaggattagataccctggtagtccacgccgtaaacgctgagtgctaggtgttgggggtcaaacctcggtgccgacgttaacacattaagcactccacctggggagtacgcacgcaagtgtgaaactcaaaggaattgacggggacccgcacaagtagcggagcatgtggtttaattcgacgcaacgcgaagaaccttaccaaggcttgacataaaacggaccggtgtagagatacaccytctcttcggagctgttttacaggtggtgcatggttgtcgtcagctcgtgttgtgaaatgttgggttaagtcccgcaacgagcgcaacccctgtcgttagttaccagcaagtaaagttggggactctaacgagactgccggtgataaaccggaggaaggtggggacgacgtcaaatcatcatgccctttatgtcttgggctacacacgtgctacaatggttgggaacaaagcgcagcaaggtcgcgaggccaagcgaatcgcagaaaaccaatctcagttcggattggaggctgcaacccgcctccatgaagtcggagttactagtaatcgtggatcagcatgccacggtgaatgcgttcccgggtcttgtacacaccgcccgtcacaccatggaagttggtaatacccgaagtcgctgagcgaaccgcaaggaagcaggcgccgaaggtaggatcaatgactggggtgaagtcgtaacaagta

SEQ ID NO: 540 - DNA, 1523 bp, Clostridiales genomosp. BVAB3
agagtttgatcctggctcaggatgaacgctggcggcgtgcttaacacatgcaagtcgaacggagctttgaggaagtgcttgcacagaattaaagcttagtggcggacgggtgagtaacgcgtgaggaacctgcctttcacagtggaataacaacgggaaaccgttgctaatggcgcatgacatcgcattgaggcatctcagagcgattaaaggagaaatccggtgaaagatggactcgcgtccgattagctagttggtgaggtaacggcccaccaaggcgacgatcggtagccgaactgagaggttgatcggccacattgggactgagacacggcccagactcctacgggaggcagcagtggggaatattgggcaatgggcgaaagcctgacccagcaacgccgcgtgaagtatgaaggccttcgggttgtaaacttctttgatcagggaagaaacaaatgacggtacctgaaaaacaagccacggctaactacgtgccagcagccgcggtaatacgtaggtggcgagcgttatccggatttactgggtgtaaagggcgtgcaggcgggctgataagtcagatgtgaaatccccgagcttaactcgggaactgcatctgatactgttggtcttgagtgctggagaggatagtggaattcctagtgtagcggtaaaatgcgcagatattaggaggaacaccagtggcgaaggcggctatctggacagtaactgacgctgaggcgcgaaagcgtgggtagcaaacaggattagataccctggtagtccacgccgtaaacgatgattactaggtgtaggaggtatcgaccccttctgtgccggagttaacacaataagtaatccacctggggagtacggccgcaaggttgaaactcaaaggaattgacgggggcccgcacaagcagtggagtatgtggtttaattcgacgcaacgcgaagaaccttaccagggtttgacatcccttgaacgatgtagagatacataattcccttcggggacaaggagacaggtggtgcatggttgtcgtcagctcgtgtcgtgagatgttgggttaagtcccgcaacgagcgcaacccctattgccagttgccatcatttagttgggcactcaggcgagactgccgttgataaaacggaggaaggtggggatgacgtcaaatcatcatgccccttatatcctgggctacacacgtactacaatggctacaacagagagcagcgacgtcgcgaggcgaagcaaatccccaaatgtagtctcagttcggattgcaggctgcaactcgcctgcatgaagccggaattgctagtaatggcaggtcagcatactgccgtgaatacgttctcgggccttgtacacaccgcccgtcacaccatgagagtcagtaacacccgaagtcagtagtctaaccgcaagggggacgctgccgaaggtgggaccgataattggggtgaagtcgtaacaaggtagccgtatcggaaggtgcggctggatcacctcctttct

SEQ ID NO: 541 - DNA, 1020 bp, Clostridiales bacterium 1_7_47FAA
  modified_base (14)..(15): a, c, t, g, unknown or other
  modified_base (969)..(969): a, c, t, g, unknown or other
  modified_base (974)..(974): a, c, t, g, unknown or other
  modified_base (977)..(977): a, c, t, g, unknown or other
  modified_base (983)..(985): a, c, t, g, unknown or other
gaacgaagcatccnnataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggganacagnggngcatgnnntcgtcagctcgtgtcgtgagatgttgggttaagtc

SEQ ID NO: 542 - DNA, 1435 bp, Clostridiales sp. SM4/1
gacgaattgactgagtggcggacgggtgagtaacgcgtgggtaacctgcctcacactgggggacaacagctggaaacggctgctaataccgcataagcgcacagcttcgcatgaagcagtgtgaaaaactccggtggtgtgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaagcccggggctcaaccgcgggactgctttggaaactgttttgctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggaacttaaccgttccttttcttcggaacattccagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagggaagcgaagctgtgaagctgagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttct

SEQ ID NO: 543 - DNA, 1297 bp, Clostridiales sp. SS3/4
gatgaacgctggcggcgtgcctaacacatgcaagtcgaacgagtggcggacgggtgagtaacgcgtgggtaacctgcctcatacagggggataacggttagaaatgactgctaataccgcataagaaaaagtggtatgagatggacccgcgtctgattagctagttggtggggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagactgacgttgaggctcgaaagcgtggggagcaaacaggattagataccctggtagtccacgccgtaaacgatgaatactaggtgttggtgcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccctattgtcagtagccagcagctgggcactctgatgagactgccagggataacctggaggaaggtggggatgacgtcaaatcatcatgccccttatgatttgggctacacacgtgctacaatggcgtacaaagagaagcgagcctgcgagggggagcaaatctcaaaacgtctcagttcggatgtagtctgcaactcgactacagaagctggaatcgctagtaatcgcagatcagaatgctgcggtgaatacgttcccgggtcttgtacacaccgcccgtcacaccatgggagtcggaaatgcccgaagccagtacccagggagctgtcgaaggcaggtctgataactggggtg

SEQ ID NO: 544 - DNA, 1378 bp, Clostridiales sp. SSC/2
  modified_base (13)..(13): a, c, t, g, unknown or other
ccttatttgattnttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactgagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccgggcgtttgcgtcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggaggga

SEQ ID NO: 545 - DNA, 1510 bp, Clostridium acetobutylicum
tttaaattgagagtttgatcctggctcaggacgaacgctggcggcgtgcttaacacatgcaagtcgagcggggaacttcggttcccagcggcggacgggtgagtaacacgtgggtaacctacctcatagtggggaatagcctttcgaaaggaagattaataccgcataatactcgagaatcgcatgattcttgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtggggacaaaaagatgcaataccgcaaggtggagcaaaactcaaaaccccatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgataattggggtgaagtcgtaacaaggtagccgtaggagaacctgcggctggatcacctcctttct

SEQ ID NO: 546 - DNA, 1470 bp, Clostridium aerotolerans
  modified_base (1082)..(1083): a, c, t, g, unknown or other
  modified_base (1085)..(1089): a, c, t, g, unknown or other
cgcgtgcttaacacatgcaagtcgagcgaagcattttaaaggaagttttcggatggaatttaagatgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtctcgtaacggagacctcccttcggggcattccagacaggtggtgcatggttgtcgtcagctcgtgtcgtgagatgttgggttaagtcccgcaacgagcgcaacccttatccttagtagccagcanntnnnnntgggcactctggggagactgccagggataacctggaggaaggtggggatgacgtcaaatcatcatgccccttatgatttgggctacacacgtgctacaatggcgtaaacaaagggaagcaaaggagcgatctggagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaagg

SEQ ID NO: 547 - DNA, 1289 bp, Clostridium aldenense
  modified_base (139)..(139): a, c, t, g, unknown or other
  modified_base (676)..(676): a, c, t, g, unknown or other
ggtgagtaacgcgtggataacctgcctcacactgggggataacagttagaaatggctgctaataccgcataagcgcacagtaccgcatgggacggtgtgaaaaacccaggtggtgtgagatggatccgcgtctgattanccagttggcggggtaacggcccaccaaagcgacgatcagtagccgacctgagagggtgaccggccacattgggactgagacacggcccaaactcctacgggaggcagcagtggggaatattgcacaatgggcgcaagcctgatgcagcgacgccgcgtgagtgaaaaaatatctcggtatgtaaagctctatcagcaggaaaaaggataaaaacccggctaactacgtgccagcagccgcggtaatacgtagggggcaagcgttatccggatttactgggtgtaaagggagcgtagacggcgacgcaagtctggagtgaaagcccggggcccaaccccgggactgctttggaaactgtgctgctggagtgcagagaggtaagtggaattcctagtgtacggtgaaatgcgtaatattagaggaacaccagtggcgaaggcggcttactggactgtaactgacgttgaggctcgaaagcgtggggagcaaacaggattagataccctggtagtccacgccgtaaacgatgaatgctangtgtcggggggcaaagcccttcggtgccgccgctaacgcaataagcattccacctggggagtacgttcgcaagaatgaaactcaaaggaattgaccgggacccgcacaagcggtggaccatgtgctttaattcgaaacaacgcgaaaaaccttaccaagtcttgacatccccctgaccggtccgtaacggggcctttccttcgggacaggggagacaggtggtgcatggttgtcgtcagctcgtgtcgtgagatgttgggttaagtcccgcaacgagcgcaacccttatccttagtagccagcacgtcgtggtgggcactctagggagactgccagggataacctggaggaaggtggggatgacgtcaaatcatcatgccccttatgatttgggctacacacgtgctacaatggcgtaaacaaagggaggcgaccctgcgaaggtaagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtg

SEQ ID NO: 548 - DNA, 1482 bp, Clostridium aldrichii
  modified_base (47)..(47): a, c, t, g, unknown or other
  modified_base (145)..(145): a, c, t, g, unknown or other
  modified_base (367)..(367): a, c, t, g, unknown or other
  modified_base (946)..(946): a, c, t, g, unknown or other
cggcgtgcttaacacatgcaagtcgagcggaaatacattgaagattnatcggatatgtattttagcggcggacgggtgagtaacgcgtgggcaatctgcctcacacaggggaataacactgggaaactagtgctaataccgcatnatatagtgaagtggcatcactttactatcaaaggagcaatccggtgtgagatgagcccgcgtccgattagctagttggtggggtaacggcccaccaaggcgacgatcggtagccgaactgagaggttgatcggccacattgggactgagacacggcccagactcctacgggaggcagcagtggggaatattgcgcaatgggggaaaccctgacgcagcaacnccgcgtgaaggatgaaggttttcggattgtaaacttctttgattggggacgataatgacggtacccaaaaaacaagccacggctaactacgtgccagcagccgcggtaatacgtaggtggcaagcgttgtccggaattactgggtgtaaagggcgtgtaggcggggatgcaagtcagatgtgaaattccgaagctcaacttcggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacataccantgacgtacttagagataggtattcccttcgggacaatggatacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagcgaagccgcgaggtggagcaaatctccaaaaatagtcccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaactgtaaagaggacgctgccgaaggtggggccgatgattggggtgaagtcgtaacaaggtagccgtatcggaaggtgcggctggatcacctcct

SEQ ID NO: 549 - DNA, 1481 bp, Clostridium algidicarnis
agagtttgatcctggctcaggacgaacgctggcggcgtgcttaacacatgcaagtcgagcgaagttattccttcggggataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagagattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagatgcaatatcgtgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgcgctaacgcgtaagcgaggcagcggccgaaggtagggtcagcgattggggtgaagtcgtaacaaggtagccgtaggaga

SEQ ID NO: 550 - DNA, 1502 bp, Clostridium algidixylanolyticum
agagtttgatcctggctcaggatgaacgctggcggcgtgcttaacacatgcaagtcgagcgaagcgattttaaggaagccttcgggtggaattagaattgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggagcaaagctcttcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgacagccttataactaaggtctccctacggggcattctagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcgaaggagcgatctggagcaaaccccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaga

SEQ ID NO: 551 - DNA, 1454 bp, Clostridium aminovalericum
  modified_base (465)..(466): a, c, t, g, unknown or other
  modified_base (572)..(573): a, c, t, g, unknown or other
  modified_base (774)..(774): a, c, t, g, unknown or other
ttaacacatgcaagtcaacggagttaatcaagcgcgaagtcttcggatggaagcttgttaacttagtggcggacgggtgagtaacgcgtgggtaacctgccttatacagggggataacagccggaaacggttgctaataccgcataagcatacagtgccgcatggtacagtgtgaaaaagattaagttcaacttcgttcaactctggtataagatggacccgcgtctgattagctagttggtgaggtaatggctcaccaatggcgacgatcagtagccggcttgagagagtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggacgataatgacggtacctgactaagaagccnnggctaactacgtgccagcagccgcggtaatacgtagggggcaagcgttatccggatttactgggtgtaaagggagcgtagacggtctggtaagtcaggtgtgaaanncccggggctcaaccccggattgcacttgaaactacccgactagagtgcaggagaggtaagtggaattcctagtgtagcggtgaaatgcgtagatattaggaggaacaccagtggcgaaggcggcttactggactgtaactgacgttgaggctcgaaagcgtggggagcgaaacaggattagataccctggtagtccacgcngtaaacgatgaatactaggtgttggggtccataaggacttcggtgccgtcgcaaacgcaataagtattccacctggggagtacgttcgcaagaatgaaactcaaaggaattgacggggacccgcacaagcgtgggagcatgtggtttaattcgaagcaacgcgaagaaccttaccaggtcttgacatccctctgaccggtccgtaatgggacctttccttcgggacagaggaacaggtggtgcatggttgtcgtcagctcgtgtcgtgagatgttgggttaagtcccgcaacgagcgcaacccctatctttagtagccagcagttcggctgggcactctagagagactgccagggataacctggaggaaggcggggatgacgtcaaatcatcatgccccttatgatctgggctacacacgtgctacaatggtgactacaaagagaagcaaagctgtgaagtggagccaatctcaaaaaggtcatctcagttcggattgtagtctgcaactcgactacatgaagctggaatcgctagtaatcgcagatcagaatgctgtggtgaatacgttcccgggtcttgtacacaccgcccgtcacaccatgggagttggatatgcccgaagtcagtgacccaaccgtaaggagggagctgccgaaggtggagccaatgactggggtg

SEQ ID NO: 552 - DNA, 1485 bp, Clostridium amygdalinum
ctcaggatgaacgctggcggcgtgcttaacacatgcaagtcgagcgaagcagttttaaggaagttttcggatggaattaaaattgactgagcggcggacgggtgagtaacgcgtgggtaacctgcctcatacagggggataacagttggaaacgactgctaataccgcataagcgcacagtgctgcatggcacggtgtgaaaaactccggtggtatgagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcagtacggctgggcactctggggagactgccagggataacctggaggaaggtggggatgacgtcaaatcatcatgccccttatgatttgggctacacacgtgctacaatggcgtaaacaaagggaagcgaaggagtgatccggagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcgga

SEQ ID NO: 553 - DNA, 1504 bp, Clostridium argentinense
agagtttgatcctggctcaggacgaacgctggcggcgtgcctaacacatgcaagtcgagcgatgaagcttccttcgggaagtggattagcggcggacgggtgagtaacacgtgggtaacctgcctctaagaggggaatagcctcccgaaagggagattaataccgcataaagtatgaaggtcgcatgacttttataccaaaggagtaatccgctatgagatggacccgcggcgcattagctagttggtgaggtaagggctcaccaaggcaacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgtcatatgggaagataatgacggtaccatatgaggaagccacggctaactacgtgccagcagccgcggtaatacgtaggtggcaagcgttgtccggatttactgggcgtaaaggatgcgtaggcggacatttaagtcagatgtgaaatacccgggctcaacttgggtgctgcatttgaaactgggtgtctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggttggtacaacaagatgcaagaccgcgaggtggagctaaacttaaaaaaccaacccagttcggattgtaggctgaaactcgcctacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcgccgaaggtgggattagtgattggggtgaagtcgtaacaaggtagccgtaggagaacctgcggttggatcacctcctt

SEQ ID NO: 554 - DNA, 1387 bp, Clostridium asparagiforme
tcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaaaaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggaggga

SEQ ID NO: 555 - DNA, 1508 bp, Clostridium baratii
gagagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcgagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcgaacaggattagataccctggtagtccacgccgtaaacgatgaatactaggtgtaggggtttcaacacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatcctctgcattacccttaatcggggaagttccttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgctataccgcgaggtggagctaaacttcaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctt

SEQ ID NO: 556 - DNA, 1364 bp, Clostridium bartlettii
tcgagcgattctcttcggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaatggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacaccccgcccgtcacaccatgggagttgggggcgcccgaagccggctagctaaccttttaggaagcggtc

SEQ ID NO: 557 - DNA, 1505 bp, Clostridium beijerinckii
agagtttgatcctggctcaggacgaacgctggcggcgtgcttaacacatgcaagtcgagcgatgaagttccttcgggaacggattagcggcggacgggtgagtaacacgtgggtaacctgcctcatagaggggaatagcctttcgaaaggaagattaataccgcataagattgtagtgccacatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctccttt

SEQ ID NO: 558 - DNA, 1329 bp, Clostridium bifermentans
  modified_base (1316)..(1316): a, c, t, g, unknown or other
  modified_base (1320)..(1321): a, c, t, g, unknown or other
gatctcttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggtaactactgccccggatacagggggtcggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcaaagctacgcgaagaaccttacctaagcttgacatccggctacgcctcacccgaagtgagcttttccatctggggaagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctancctnntaggaagc

SEQ ID NO: 559 - DNA, 1377 bp, Clostridium bolteae
  modified_base (13)..(13): a, c, t, g, unknown or other
gaagcaattaaanggaagttttcggatggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccttttgaccggcgtgtaacggcgccttcccttcggggcaagagagacaggtggtgcatggccgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaag

SEQ ID NO: 560 - DNA, 1355 bp, Clostridium botulinum
tgaagcttccttcgggaagtggattagcggcggacgggtgagtaacacgtgggtaacctgcctcaaagtgggggatagccttccgaaaggaagattaataccgcataacataagagaatcgcatgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgagaaggtcttcggattgtaacctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagagtaaaactcaaaggaattgacgggggcccgcacaagcagcggagcatgtggtttaattcgaagcaacgcgaaaaaccttacctggacttgacatcccttgcatagcctagagataggtgaagcccttcggggcaaggagacaggaggtgcatgggtgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagc

SEQ ID NO: 561 - DNA, 1366 bp, Clostridium butyricum
tcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggacatgtggtttaattgaagcaacgcgaagaaccttacctagacttgacatctcctgaattctctgtaatggagaagccacttcggtggcaggaagacaggtggtgcatggttgtggtcagctcgtgtcgtgagatgttgggttaagtcccgcaacgagcgcaacccttattgttagttgctcccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtagggtgaaactcgcctacatgaagctggagttgctagtaatcgcgaatcagaatgtcgcggagaatacgttcccgggccttgtacacaccgcccgtcacaccatgagagttggcaatacccaaagttcgtgagctaaccgcaaggaggca

SEQ ID NO: 562 - DNA, 1473 bp, Clostridium cadaveris
agagtttgatcctggctcaggatgaacgctggcggcgtgcttaacacatgcaagtcgagcgagggagcaccttcgggtgtgaactagcggcggacgggtgagtaacacgtgggcaacctgccttacagagggggatagccttccgaaaggaagattaataccgcatattatgatttttctgcatgggaaagtcatgaaaggagcaatccgctgtaagatgggcccgcggcgcattagctagttggtgaggtaagggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttatccggatttactgggcgtaaaggatgcgtaggtggaattttaagtgggatgtgaaatacccgggctcaacctgggaactgcattccaaactggaattctagagtgcaggagaggaaagcggaattcctagtgtagcggtgaaatgcgtagagattaggaagaacaccagtggcgaaggcggctttctggactgtaactgacactgaggcatgaaagcgtggggagcaaacaggattagataccctggtagtccacgccgtaaacgatgggtactaggtgtaggggtttcgatacctctgtgccgccgtaaacacaataagtaccccgcctggggagtacggtcgcaagattaaaactcaaaggaattgacgggggcccgcacaagtagcggagcatgtggtttaattcgaagcaacgcgaagaaccttacctagacttgacatgtcctgaattacctgtaataagggaagctctttcgggagcaggaacacaggtggtgcatggttgtcgtcagctcgtgtcgtgagatgttgggttaagtcccgcaacgagcgcaacccctatagttagttgctaacagtaagatgagcactctagctagactgccgtggttaacgcggaggaaggtggggatgacgtcaaatcatcatgccccttatgtctagggctacacacgtgctacaatggcgagaacaaagagaagcaagaccgcgaggtggagcaaaactcataaaactcgtcccagttcggattgcaggctgcaactcgcctgcatgaagccggagttactagtaatcgcgaatcagaatgtcgcggtgaatacgttcccgggccttgtacacaccgcccgtcacaccatgagagttggcaatacccaaagtccgtgaggtaaccgaaaggagccagcggcctaaggtagggtcagcgattggggtgaagtcgtaacaaggtaacc

SEQ ID NO: 563 - DNA, 1499 bp, Clostridium carboxidivorans
ttgatcctggctcaggacgaacgctggcggcgtgcttaacacatgcaagtcgagcgatgaaatcccttcggggatggattagcggcggacgggtgagtaacacgtgggcaacctgcctcaaagtgggggatagccttccgaaagggagattaataccgcataacattagtttttcacatgaaatactaattaaaggagtaatccgctttgagatgggcccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtctttggggacgataatgacggtacccaaggaggaagccacggctaactacgtgccagcagccgcggtaatacgtaggtggcgagcgttgtccggatttactgggcgtaaaggatgcgtaggcggatgtttaagtcagatgtgaaaatcccgagcttaacttgggaactgcatttgaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgaatactaggtgtaggaggtatcgactccttctgtgccgcagctaacgcaataagtattccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacagaaagatgcaagaccgtgaggtggagcaaaacttttaaaactcatctcagttcggattgtaggctgaaactcgcctacatgaagctggagttgctagtaatcgcgaatcagcatgtcgcggtgaatacgttcccgggccttgtacacaccgcccgtcacaccatgagagctggcaacacccgaagtccgtgaggtaaccgtaaggagccagcggccgaaggtggggttagtaattggggtgaagtcgtaacaaggtagccgtaggagaacctgcggctggatcacctcctt

SEQ ID NO: 564 - DNA, 1458 bp, Clostridium carnis
  modified_base (1)..(3): a, c, t, g, unknown or other
  modified_base (92)..(92): a, c, t, g, unknown or other
  modified_base (96)..(97): a, c, t, g, unknown or other
  modified_base (606)..(607): a, c, t, g, unknown or other
  modified_base (837)..(837): a, c, t, g, unknown or other
  modified_base (930)..(944): a, c, t, g, unknown or other
  modified_base (1172)..(1172): a, c, t, g, unknown or other
  modified_base (1360)..(1360): a, c, t, g, unknown or other
nnntaggtgagagtttgatcctggctcaggacgaacgctggcggcgtgcctaacacatgcaagtcgagcgaggggagtttcttcggaaaccnaacnnagcggcggacgggtgagtaacacgtgggcaacctgccttgtagaggggaatagccttccgaaaggaagattaataccgcataatattgcagcttcgcatgaagcagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggacttttaagtgagatgtgaaatacccgggctcaacctgggnnctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgcngctaacgcattaagtattccgcctggggagtacggtcgcaagattaaaactcaaaggaattgacgggggcccgcacaagcagcggagcatgtnnnnnnnnnnnnnnnaacgcgaagaaccttacctagacttgacatctcctgcattactcttaatcgaggaagtcctttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcnaatcatcatgccccttatgtctagggctacacacgtgctacaatggcaagtacaaagagatgcaataccgcgaggtggagctaaactataaaacttgtctcagttcggattgtaggctgaaactcgcctacatgaagctggagttgctagtaatcgcgaatcagcatgtcgcggtgaatacgttcccnggccttgtacacaccgcccgtcacaccatgagagttggcaatacccaaagttcgtgagctaaccgcaaggaggcagcgacctaaggtagggtcagcga

SEQ ID NO: 565 - DNA, 1012 bp, Clostridium celatum
  modified_base (14)..(14): a, c, t, g, unknown or other
  modified_base (40)..(42): a, c, t, g, unknown or other
  modified_base (63)..(63): a, c, t, g, unknown or other
  modified_base (107)..(107): a, c, t, g, unknown or other
  modified_base (109)..(109): a, c, t, g, unknown or other
  modified_base (111)..(111): a, c, t, g, unknown or other
gggtgtaaagctcngtcttcagggacgataatgacggtannngaggaggaagccacggctaantacgtgccagcagccgcggtaatacgtaggtggcgagcgttgtncngnatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagtcgcttcggcgacaggaagacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctgactcgcaagagagga

SEQ ID NO: 566 - DNA, 1435 bp, Clostridium celerecrescens
catgcaagtcgagcgaagcgatttcaaggaagttttcggacggaattgaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaatttgacggggacccgcacaagcggtggagcatgtggtttaattcgaagcaacgcgaagaaccttaccaagtcttgacatcggaatgaccgggatgtaacgatcccttccctacggggcattccagacaggtggtgcatggttgtcgtcagctcgtgtcgtgagatgttgggttaagtcccgcaacgagcgcaacccttatccttagtagccagcaagttaagttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcg

SEQ ID NO: 567 - DNA, 1500 bp, Clostridium cellulosi
  modified_base (1380)..(1381): a, c, t, g, unknown or other
tttgatcctggctcaggacgaacgctggcggcgtgcctaacacatgcaagtcgagcggagatagtacttcggttctatcttagcggcggacgggtgagtaacgcgtgagcaacctgccctgagcacggggatagcgtctggaaacggacggtaataccgcataatgtacgttggaggcatctccgatgtaccaaaggaggaatccactcaaggatgggctcgcgtccgattaggtagttggtgaggtaacggcccaccaagcctgcgatcggtagccggactgagaggttgtacggccacattgggactgagacacggcccagactcctacgggaggcagcagtggggaatattgcacaatggaggaaactctgatgcagcgacgccgcgtgagggaagaaggtcttcggattgtaaacctctgtctttcgggacgaaggaagtgacggtaccgaaagaggaagccacggctaactacgtgccagcagccgcggtaatacgtaggtggcgagcgttgtccggaattactgggtgtaaagggtgcgtaggcgggttgtcaagttggatgtgaaatctctgggcttaactcagaggttgcattcaaaactggcgatcttgagtgaggtagaggcaggcggaattcccggtgtagcggtgaaatgcgtagatatcgggaggaacaccagtggcgaaggcggcctgctgggccttaactgacgctgaggcgcgaaagcgtggggagcaaacaggattagataccctggtagtccatgctgtaaacgatgattgctaggtgtgggtggactgaccccatccgtgccggagttaacacaataagcatcccacctggggagtacggccgcaaggctgaaactcaaaggaattgacgggggcccgcacaagcagtggagtatgtggtttaattcgaagcaacgcgaagaaccttaccaggtcttgacatccaccgaatccggaagagattctggagtgcccttcggggagcggtgagacaggtggtgcatggttgtcgtcagctcgtgtcgtgagatgttgggttaagtcccgcaacgagcgcaacccttgttaatagttgctacgcaagagcactctattaagactgccgttgataaaacggaggaaggtggggatgacgtcaaatcatcatgccccttatgacctgggctacacacgtactacaatggccgccaacaaagggaagcaataccgcgaggtggagcgaatccccaaaagcggtcccagttcagattgcaggctgcaacccgcctgcatgaagacggaattgctagtaatcgcggatcagcatgccgcggtgaatacgttcccgggccttgtacacaccgcccgtcacaccatgagagnnggcaacacccgaagtcgtttgcgtaaccgaaaggagcgcggcgccgaaggtgggatcggtgattggggtgaagtcgtaacaaggtagccgtatcggaaggtgcggctggatcacctcct

SEQ ID NO: 568 - DNA, 1283 bp, Clostridium chauvoei
tgggcaacctgccttgtagaggggaatagccttccgaaaggaagattaataccgcataatattgcagcttcgcatggagcagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggattttttgggcgtaaagggagcgtaggcggacttgtaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatggatactaggtgtgggaggtatcaactccttccgtgccgccgttaacacattaagtatcccgcctggggagtacggtcgcaagattaaaactcaaaggaattgacgctagcccgcacaagcagcggagcatgtggtttaattcgaagcaacgcgaagaaccttacctagacttgacatctcctgcattactcttaatcgaggaagtctcttcggagacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggtagtgacgtcaaatcatcatgccccttatgtctagggctacacacgtgctagaatggcaagtacaacgagatgcaataccgcgaggtggagctaaactataaaacttgtctcagttcggattgtaggctgaaactcgcctacatgaagctggagttgctagtaatcgcgaatcagcatgtcgcggtgaatacgttcccgagccttgtacacaccgcccgtcacaccatgagagttggcaata

SEQ ID NO: 569 - DNA, 1383 bp, Clostridium citroniae
  modified_base (12)..(14): a, c, t, g, unknown or other
acgaagcaattnnnaatgaagttttcggatggatttctgattgactgagtggcggacgggtgagtaacgcgtggataacctgcctcacactgggggataacagttagaaatggctgctaataccgcataagcgcacagtaccgcatggtacggtgtgaaaaactccggtggtgtgagatggatccgcgtctgattagttagttggcggggtaacggcccaccaagacagcgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctggagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggtcggtaaagcggcctttccttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgaccctgcgaaggcaagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggag

SEQ ID NO: 570 - DNA, 1560 bp, Clostridium clariflavum
gacgaacgctggcggcgtgcctaacacatgcaagtcgagcggtcctgcattcaacattgagtattcagctgacgttggagattgagccggcgtcaagcagaaacaaccatatactatgatatgtttaaagtttctgcttcacgctgaataaagtgccaacacaaaaaggagctgagtattgaatgttgaatgcaggatagcggcggacgggtgagtaacgcgtgggtaatctgcctcacacagggggataacactgggaaactagtgctaataccgcataacataacgaggtggcatcactttgttatcaaaggagcaatccggtgtgagatgagcccgcgtccgattagctagttggtgaggtaacggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggtcttcggattgtaaacttctttggttggggacgataatgacggtacccaaggaacaagccacggctaactacgtgccagcagccgcggtaatacgtaggtggcgagcgttgtccggaattactggatgtaaagggcgcgtaggcggggatgcaagtcagatgtgaaattccggggctcaaccccggcgctgcatctgaaactgtatttcttgagtgttggagaggaaagcggaattcctagtgtagcggtgaaatgcgtagagattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccctctgacagctctagagatagggcttctcttcggagcagaggagacaggtggtgcatggttgtcgtcagctcgtgtcgtgagatgttgggttaagtcccgcaacgagcgcaacccttgttgttagttgccatcattaagttgggcactctaacgagactgccggtgataaatcggaggaaggtggggacgacgtcaaatcatcatgccccttatgtcctgggctacacacgtactacaatggctgctacaaagggaagcgagaccgcgaggtggagcaaatccccaaaagcagtcccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgagaggagggcgctgccgaaggtggggcagatga

SEQ ID NO: 571 - DNA, 1475 bp, Clostridium clostridiiformes
  modified_base (534)..(534): a, c, t, g, unknown or other
  modified_base (917)..(917): a, c, t, g, unknown or other
  modified_base (954)..(954): a, c, t, g, unknown or other
  modified_base (1010)..(1010): a, c, t, g, unknown or other
  modified_base (1453)..(1453): a, c, t, g, unknown or other
  modified_base (1471)..(1471): a, c, t, g, unknown or other
aacatgagagtttgatcctggctcaggatcaacgctggcggcgtgcctaacacatgcaagtcgaacgaagcaattaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtagtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcnagcgttatccggatttactgggtgtaaagggagcgtagacggcgaagcaagtctgaagtgaaaacccagggctcaaccctggcactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagccttcggtgccgccgcaaacgcagtaagcattccacctggggagtacgttcgcaagaatgaaactcaaaggaattgacgggganccgcacaagcggtggagcatgtggtttaattcgaagnaacgcgaagaaccttaccaagtcttgacatccccctgacggccggtaacgcggccnttcttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccnaaggcggggcaggtaacngggg

SEQ ID NO: 572 - DNA, 1370 bp, Clostridium clostridioforme
attaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaagacggtacctgctaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccccctgacgggccggtaacgcgggcgtttcattgggtagaggtagacaggtggagcatgggcgtcgtcagctcgtgtcgtgagatgttgggttaagtcccgcaacgagcgcaacccttatccttagtagccagcacgtgaaggtgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaagg

SEQ ID NO: 573 - DNA, 1521 bp, Clostridium coccoides
tttgagtttgatcctggctcaggatgaacgctggcggcgtgcttaacacatgcaagtcgagcgaagcgctaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcccc

SEQ ID NO: 574 - DNA, 1462 bp, Clostridium cochlearium
  modified_base (1)..(2): a, c, t, g, unknown or other
  modified_base (289)..(289): a, c, t, g, unknown or other
  modified_base (523)..(523): a, c, t, g, unknown or other
  modified_base (930)..(943): a, c, t, g, unknown or other
  modified_base (967)..(967): a, c, t, g, unknown or other
  modified_base (1136)..(1136): a, c, t, g, unknown or other
  modified_base (1213)..(1213): a, c, t, g, unknown or other
  modified_base (1363)..(1363): a, c, t, g, unknown or other
  modified_base (1383)..(1383): a, c, t, g, unknown or other
  modified_base (1458)..(1458): a, c, t, g, unknown or other
nnttaaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagaggggaatagccctccgaaaggaggattaataccgcataaagttagagtttcgcatgaaactttaaccaaaggagtaatctgctttgagatgggcccgcgtcccattagctagttggtaaggtaatggcttaccaaggcaacgatgggnagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcnagcgttgtccggatttactgggcgtaaagggtgcgtaggcggatgcttaagtgagatgtgaaatacctaggcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtgnnnnnnnnnnnnnnaacgcgaagaaccttacctggacntgacatcccctgaattactcgtaactgaggaaatctcttcggagacagggagacaggtggtgcatggttgtcgtcagctcgtgtcgtgagatgttgggttaagtcccgcaacgagcgcaacccttattattagttgctaccattaagttgagcactctaatgagactgnccgggtgaaccgggaggaaggtggggatgacgtcaaatcatcatgccccttatgtccagggctacacacgtgctacnatggtgggtacagagagaagcgataccgcgaggtggagcaaatctcaaaaacccatcccagttcggattgcaggctgaaactcgcctgcatgaagccggagttgctagtaatcgcaaatcagaatgttgcggtgaatacgttcccgggcnttgtacacaccgcccgtcanaccatgagagttggcaacacccgaagtccgtgaggtaaccgtaaggagccagcggccgaaggtggggttaatgantggg

SEQ ID NO: 575 - DNA, 1489 bp, Clostridium cocleatum
ctcaggatgaacgctggcggcgtgcctaatacatgcaagtcgaacgcgggcacttgtgcccgagtggcgaacgggtgagtaatacataagtaacctggcctttacagggggataactgctggaaacggtagctaagaccgcataggtagggacactgcatggtgaccgtattaaaagtgctgcaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaaaggcggatggaggaaatgacatccgagtgacggtactttatgagaaagccacggctaactacgtgccagcagccgcggtaatacgtaggtggcaagcgttatccggaattattgggcgtaaagagggagcaggcggcagcaaaggtctgtggtgaaagactgaagcttaacttcagtaagccatagaaaccaggcagctagagtgcaggagaggatcgtggaattccatgtgtagcggtgaaatgcgtagatatatggaggaacaccagtggcgaaggcgacgatctggcctgtaactgacgctcagtcccgaaagcgtggggagcaaataggattagataccctagtagtccacgccgtaaacgatgagtactaagtgttggaagtcaaatttcagtgctgcagttaacgcagtaagtactccgcctgagtagtagcttcgcaagaatgaaactcaaaggaattgacgggggcccgcacaagcggtggagcatgtggtttaattcgaagcaacgcgaagaaccttaccaggtcttgacatactcataaaggatccagagatggatagatagttatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggcgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgaaaggaaggagctgtctaaggtgggattgatgattggggtgaagtcgtaacaaggtatccctacgggaacgtgggg

SEQ ID NO: 576 - DNA, 1451 bp, Clostridium colicanis
  modified_base (729)..(729): a, c, t, g, unknown or other
  modified_base (873)..(873): a, c, t, g, unknown or other
agtcgagcgatgaaattttcttcggaaatggattagcggcggacgggtgagtaacacgtgggtaacctgccctatagagagggatagccttccgaaagggagattaatacctcataatatcctagtatcgcatgatacatggattaaaggagcaatccgctataggatggacccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggcggatctttaagtgggatgtgaaatactcgggctcaacctgggggctgcattccaaactggggatctagagtacaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtanacgatgaatactaggtgtagggggtgtcaactccccctgtgccgccgctaacgcattaagtattccgcctggggagtacggtcgcaagattaaaactcaaaggaattgacgggggcccgcacaagtagcggagcatgtggtttnattcgacgcacgcgaagaacttacctagacttgacatcttctgcattacccttaatcggggaagttccttcggggacagaatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacagaaagacgcgataccgcgaggtggagcaaaactttaaaaccggtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcct

SEQ ID NO: 577 - DNA, 1473 bp, Clostridium colinum
cggcgtgcctaacacatgcaagtcgagcggagttttatgggagcttgcttttataaaacttagcggcggacgggtgagtaacgcgtgggtaacctgccctatacacagggataacattgagaaattgatgctaatacctgataagccaacagtaggcatctacaagttggaaaaactgaggtggtataggaggggcccgcgtctgattagctagttggtggggtaaaggcctaccaaggcgacgatcagtagccgacctgagagggtgatcggccacattggaactgagacacggtccaaactcctacgggaggcagcagtggggaatattgcacaatggggggaaccctgatgcagcaacgccgcgtgaaggaagaagtatttcggtatgtaaacttctatcgacagggaagaaataaatgacggtacctgaataagaagcaccggctaaatacgtgccagcagccgcggtaatacgtatggtgcaagcgttatccggatttactgggtgtaaagggtgagtaggcggttatgcaagtcatatgtgaaattctggggctcaacctcagggctgcataagaaactgtgtaactagagtacaggagaggtaagcggaattcctagtgtagcggtgaaatgcgtagatattaggaagaacaccggtggcgaaggcggcttactggactgaaactgacgctgagtcacgaaagcgtggggagcgaacaggattagataccctggtagtccacgccgtaaacgatgagtgctaggtgttgggaagagattctcggtgccgcagcaaacgcaataagcactccacctggggagtacgaccgcaaggttgaaactcaaaggaattgacggggaccgcacaagcggtggagcatgtggtttaattcgaagcaacgcgaagaaccttacctaaacttgacatcccgatgacaatctgtgtaatgcagactttcttcggaacatcggtgacaggtggtgcatggttgtcgtcagctcgtgtcgtgagatgttgggttaagtcccgcaacgagcgcaacccctattcttagtagccagcawttcggatgggcactctagggagactgccgtggataacacggaggaaggtggggatgacgtcaaatcatcatgccccttatgtttagggctacacacgtgctacaatggctgtaacaaagtgaagcaagatagtgatatggagcaaagcacaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatgggagttggaagcgcccgaagcctgtgacctaaccgcaaggaggagcagtcgaaggtgaagccagtgactggggtgaagtcgtaacaaggtagccgtatcggaaggtgcgctgatcacctcc

SEQ ID NO: 578 - DNA, 1365 bp, Clostridium difficile
  modified_base (1347)..(1347): a, c, t, g, unknown or other
  modified_base (1352)..(1353): a, c, t, g, unknown or other
ttgagcgatttacttcggtaaagagcggcggacgggtgagtaacgcgtgggtaacctaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattcctagtgtagcggtgaaatgcgtagatattaggaggaacaccagttgcgaaggcggctctctggactgtaactgacgctgaggcacgaaagcgtggggagcaaacaggattagataccctggtagtccacgctgtaaacgatgagtactaggtgtcgggggttacccccttcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccaatgacatctccttaatcggaaagttcccttcggggagattggggacagaggggaattgcttgtgtagcgctggtatggggagatattgggataagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgattatctanccttnngaagaagtcgtc

SEQ ID NO: 579 - DNA, 1379 bp, Clostridium disporicum
  modified_base (14)..(14): a, c, t, g, unknown or other
  modified_base (28)..(29): a, c, t, g, unknown or other
tcgagcgagtggangttcttcggaacannagctagcggcggacgggtgagtaacacgtgggcaacctgcctcatagaggggaatagcctcccgaaagggagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaatgccgcgtgagtgatgacggccttcgggttgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatttttaagtgagatgtgaaatacccgggcttaacttgggtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaactggggaagtcgcttcggcgacaggaagacagtaggtgcatggaagtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctaactcgcaagagaggaagcgccc

SEQ ID NO: 580 - DNA, 1473 bp, Clostridium estertheticum
cctggctcaggacgaacgctggcggcgtgcctaacacatgcaagtcgagcgatgcgatccttcggggtcaattagcggcggacgggtgagtaacacgtgggtaacctgcctcaaagaggggaatagcctcccgaaagggagattaataccgcataatatgttttgatcgcatgatcttaacatcaaaggaatttttcggaatttcactttgagatggacccgcggcgcattagctagttggtgaggtaaaggcccaccaaggcaacgatgcgtagccgacctgagagggtgatcggccacattggaactgagacacggtccagactcctacgggaggcagcagtggggaatattgcgcaatgggggaaaccctgacgcagcaacgccgcgtgaatgatgaaggccttcgggttgtaaagttctgtcttctgggacgataatgacggtaccagaggaggaagccacggctaactacgtgccagcagccgcggtaatacgtaggtggcaagcgttgtccggatttactgggcgtaaaggatgcgtaggcggacatttaagtcagatgtgaaatacccgagcttaacttgggtgctgcatttgaaactgggtgtctagagtgcaggagaggtaagtggaattcctagtgtagcggtgaaatgcgtagagattaggaagaacaccagtggcgaaggcgacttactggactgtaactgacgctgaggcatgaaagcgtggggagcaaacaggattagataccctggtagtccacgccgtaaacgatgaatactaggtgtcgggggtcgaacctcggtgccgccgttaacacattaagtattccgcctggggagtacgatcgcaagattaaaactcaaaggaattgacgggggcccgcacaagcagcggagcatgtggtttaattcgaagcaacgcgaagaaccttacctagacttgacatcccttgcataactcagagatgagtgaagtccttcgggacaaggtgacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacaaagagatgcaagaccgcaaggtggagccaaactcaaaaactcatcccagttcggattgtaggctgcaactcgcctacatgaagccggagttgctagtaatcgcgaatcagcatgtcgcggtgaatacgttcccgggccttgtacacaccgcccgtcacaccatgagagttggtaacacccgaagtccgtgaggtaaccgtaaggagccagcggccgaaggtgggatcgatgattggggtgaagtcgtaacaaggtagccgtaggaga

SEQ ID NO: 581 - DNA, 1465 bp, Clostridium fallax
  modified_base (1)..(3): a, c, t, g, unknown or other
  modified_base (164)..(164): a, c, t, g, unknown or other
  modified_base (238)..(238): a, c, t, g, unknown or other
  modified_base (337)..(338): a, c, t, g, unknown or other
  modified_base (421)..(421): a, c, t, g, unknown or other
  modified_base (523)..(523): a, c, t, g, unknown or other
  modified_base (858)..(858): a, c, t, g, unknown or other
  modified_base (935)..(935): a, c, t, g, unknown or other
  modified_base (939)..(945): a, c, t, g, unknown or other
  modified_base (1151)..(1151): a, c, t, g, unknown or other
  modified_base (1171)..(1172): a, c, t, g, unknown or other
  modified_base (1360)..(1360): a, c, t, g, unknown or other
  modified_base (1461)..(1462): a, c, t, g, unknown or other
nnntaaattgagagtttgatcctggctcaggacgaacgctggcggcgtgcttaacacatgcaagtcgagcgagagagttttcttcggaaaactatctagcggcggacgggtgagtaacacgtgggtaacctgcctcatagagggggatagcctcccgaaagggngattaataccgcataacatcattttagcgcatgctcaaatgatcaaaggagtaatccgctatgagatggacccncggcgcattagctagttggtgaggtaacggctcaccaaggccacgatgcgtagccgacctgagagggtgatcggccacattgggactgagacacggccnngactcctacgggaggcagcagtggggaatattgcacaatgggggaaaccctgatgcagcaacgccgcgtgagtgatgacggcnttcgggttgtaaagctctgtctttagggacgataatgacggtacctaaggaggaagccacggctaactacgtgccagcagccgcggtaatacgtaggtggcnagcgttgtccggatttactgggcgtaaagggagcgtaggtggattcttaagtgagatgtgaaatacccgggcttaacttgggtcctgcatttcaaactgggaatctagagtgcaggagaggaaagtggaattcctagtgtagcggtgaaatgcgtagagattaggaagaacaccagtggcgaaggcgactttctggactgtaactgacactgaggctcgaaagcgtggggagcaaacaggattagataccctggtagtccacgccgtaaacgatggatactaggtgtgggaggtatcaactccttccgtgccgccgttaacacattaagtatccngcctggggagtacggtcgcaagattaaaactcaaaggaattgacggggacccgcacaagcagcggagcatgtggttnaatnnnnnnnaacgcgaagaaccttacctagacttgacatctcctgaattactcttaatcgaggaagcccttcggggacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccggnaggaaggtggggatgacgtnnaatcatcatgccccttatgtctagggctacacacgtgctacaatggctggtacaaagagaagcaagaccgtgaggtggagcaaaactcaaaaaccagtcccagttcggattgtaggctgaaactcgcctacatgaagccggagttgctagtaatcgcgaatcagcatgtcgcggtgaatacgttcccnggtcttgtacacaccgcccgtcacaccatgagagttggcaatacccgaagtctgtgagctaacctgtaaagggggcaacggccgaaggtagggtcagcgannggg

SEQ ID NO: 582 - DNA, 1011 bp, Clostridium favososporum
  modified_base (8)..(8): a, c, t, g, unknown or other
  modified_base (855)..(855): a, c, t, g, unknown or other
  modified_base (929)..(929): a, c, t, g, unknown or other
  modified_base (943)..(943): a, c, t, g, unknown or other
  modified_base (945)..(947): a, c, t, g, unknown or other
  modified_base (949)..(949): a, c, t, g, unknown or other
  modified_base (991)..(991): a, c, t, g, unknown or other
gcgatgantttccttcgggaaacggattagcggcggacgggtgagtaacacgtgggtaacctgccttatagtgggggatagcctttcgaaaggaagattaataccgcataagattgtagtatcgcatgatatagcaattaaaggagcaatccgctataagatggacccgcgtcgcattagctagttggtgaggtaatggctcaccaaggcgacgatgcgtagccgacctgagagggtgatcggccacattgggactgagacacggcccagactcctacgggaggcagcagtggggaatattgcacaatgggcgaaagcctgatgcagcaacgccgcgtgagtgatgacggccttcgggttgtaaaactctgtcttcagggacgataatgacggtacctgaggaggaagccacggctaactacgtgccagcagccgcggtaatacgtaggtggcaagcgttgtccggatttactgggcgtaaagggagcgtaggcggatgtttaagtgggatgtgaaatactcgggctcaacttgagtgctgcattccaaactggatatctagagtgcaggagaggaaaggagaattcctagtgtagcggtgaaatgcgtagagattaggaagaataccagtggcgaaggcgcctttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggancatgtggtttaattcgaagcaacgcgaagaaccttacctagacttgacatctcctgaattactctgtaatggangaagctcttcggancnnnanacaggtggtgcatggttgtcgtcagctcgtgtcgtgagatgntgggttaagtcccgcaacga

SEQ ID NO: 583 - DNA, 1439 bp, Clostridium felsineum
aacgctggcggcgtgcttaacacatgcaagtcgagcggggaacttcggttcccagcggcggacgggtgagtaacacgtgggtaacctgcctcatagtggggaatagccttccgaaaggaagattaataccgcataatactcggaaatcacatgatttctgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgatgatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgatgattggggtgaagtcgtaacaaggt

SEQ ID NO: 584 - DNA, 1481 bp, Clostridium frigidicarnis
agagtttgatcctggctcaggatgaatgctggcggcgtgcttaacacatgcaagtcgagcgagagagtctcttcggagacaatagcggcggacgggtgagtaacacgtgggcaacctgccttgtagtgggggatagccctccgaaaggaggattaataccgcatattgtcacattgaggcatctcaaagtgatgaaaggagtaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggattgtaaagctctgtcttcggggacgataatgacggtacccgaggaggaagccacggctaactacgtgccagcagccgcggtaatacgtaggtggcaagcattatccggatttactgggcgtaaagggtgcgtaggcggatttttaagtgagatgtgaaatacccgggctcaacctgggggctgcatttcaaactggaaatctagagtgcaggagaggaaagtggaattcctagtgtagcggtgaaatgcgtagagattaggaagaacaccagtggcgaaggcgactttctggactgtaactgacgctgaggcacgaaagcgtggggagcaaacaggattagataccctggtagtccacgccgtaaacgatggatactaggtgtgggaggtttaactccttccgtgccgccgttaacacattaagtatcccgcctggggagtacggtcgcaagattaaaactcaaaggaattgacgggggcccgcacaagtagcggagcatgtggtttaattcgaagcaacgcgaagaaccttacctagacttgacatgtcctgaattaccagtaatgtgggaagtccttcggggacaggaacacaggtggtgcatggttgtcgtcagctcgtgtcgtgagatgttgggttaagtcccgcaacgagcgcaacccctattgttagttgctaccattaagttgagcactctagcgagactgcctgggataaccaggaggaaggcggggatgacgtcaaatcatcatgccccttatgtctagggctacacacgtgctacaatggcaagtacaaagagatgcaagaccgcgaggtggagctaaactcataaaacttgtctcagttcggattgtaggctgaaactcgcctacatgaagctggagttactagtaatcgcgaatcagaatgtcgcggtgaatacgttcccgggccttgtacacaccgcccgtcacaccatgagagttggcaatacccaacgtccgtgagctaacctgtaagggaggcagcggcctaaggtagggtcagcgattggggtgaagtcgtaacaaggtagccgtaggaga

SEQ ID NO: 585 - DNA, 1483 bp, Clostridium gasigenes
agagtttgatcctggctcaggacgaacgctggcggcgtgcctaacacatgcaagtcgagcgagaggagttcttcggaacgaatctagcggcggacgggtgagtaacacgtgggcaacctaccttatagaggggaatagccttccgaaaggaagattaataccgcataacattgcagtttcgcatgaaacagcaattaaaggagaaatccgctataagatgggcccgcggcgcattagctagttggtgaggtaaaggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaaactctgtctttggggacgataatgacggtacccaaggaggaagccacggctaactacgtgccagcagccgcggtaatacgtaggtggcaagcgttgtccggatttactgggcgtaaagggagcgtaggtggatttttaagtgaggtgtgaaatactcgggctcaacccgagaactgcatttcaaactggaaatctagagtgcaggagaggaaagtggaattcctagtgtagcggtgaaatgcgtagatattaggaagaacaccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccgtaattggggaagtggcttcggccacaggaagacaggtggtgcatggttgtcgtcagctcgtgtcgtgagatgttgggttaagtcccgcaacgagcgcaacccttattgttagttgccatcatttagttgggcactctagcgagactgcccgggttaaccgggaggaaggtggggatgacgtcaaatcatcatgccccttatgtctagggctacacacgtgctacaatggcaagtacaaagagaagcaagaccgcgaggtggagccaaactataaaacttgtctcagttcggattgcaggctgaaactcgcctgcatgaagctggagttgctagtaatcgcgaatcagcatgtcgcggtgaatacgttcccgggccttgtacacaccgcccgtcacaccacgagagttggcaatacccaaagttcgtgagctaacccgcaagggaggcagcgacctaaggtagggtcagcgattggggtgaagtcgtaacaaggtagccgtaggaga

SEQ ID NO: 586 - DNA, 1359 bp, Clostridium ghonii
tcgagcgaacccttcggggtgagcggcggacgggtgagtaacgcgtgggtaacctgccctgtacacacggataacataccgaaaggtatgctaatacgggataacatatgagagtcgcatggcttttgtatcaaagctccggcggtacaggatggacccgcgtctgattagctagttggtaaggtaacggcttaccaaggcaacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccattgacctctccctaatcggagatttcccttcggggacagtggtgacaggtggtgcatggctgtcgtcagctcgtgtcgtgagatgttggggtaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctaaccttttaggaagcg

SEQ ID NO: 587 - DNA, 1333 bp, Clostridium glycolicum
ttcggagaagagcggcggacgggtgagtaacgcgtgggtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggtttactgggcgtaaagggtgcgtaggtggtttcttaagtcaggagtgaaaggtacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggggcatgggagtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaac

SEQ ID NO: 588 - DNA, 956 bp, Clostridium glycyrrhizinilyticum
  modified_base (907)..(907): a, c, t, g, unknown or other
  modified_base (935)..(935): a, c, t, g, unknown or other
tcgaacgaagcactttaccggatttcttcggaatgaaagttttgtgactgagtggcggacgggtgagtaacgcgtgggtaacctgcctcatacagggggataacagttagaaatgactgctaataccgcataagaccacaggattgcatggtccggtggtaaaaactccggtggtatgagatggacccgcgtctgattaggtagttggtggggtaacggcttaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaancttacctgcccttgacatccggctgacnggcgagtaatgtcgcctttcc

SEQ ID NO: 589 - DNA, 1465 bp, Clostridium haemolyticum
gacgaacgctggcggcgtgcctaacacatgcaagtcgagcgatgaaacttccttcgggaagtggattagcggcggacgggtgagtaacacgtgggtaacctgcctcaaagagggggatagcctcccgaaagggagattaataccgcataacattattttatggcatcatagaataatcaaaggagcaatccgctttgagatggacccgcggcgcattagctagttggtgaggtaagggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtctttagggacgataatgacggtacctaaggaggaagccacggctaactacgtgccagcagccgcggtaatacgtaggtggcaagcgttgtccggatttactgggcgtaaagagtatgtaggtgggtgcttaagtcagatgtgaaattcccgggcttaacctgggcgctgcatttgaaactgggcatctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacc

SEQ ID NO: 590 - DNA, 1384 bp, Clostridium hathewayi
  modified_base (19)..(19): a, c, t, g, unknown or other
  modified_base (939)..(939): a, c, t, g, unknown or other
  modified_base (942)..(942): a, c, t, g, unknown or other
  modified_base (980)..(980): a, c, t, g, unknown or other
gtcgagcgaagcggtttcnatgaggttttcggatggatttgaaattgacttagcggcggacgggtgagtaacgcgtgggtaacctgccttacactgggggataacagttagaaatgactgctaataccgcataagcgcacagggccgcatggtccggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacaggggcaagcgtccggattactgggtgtaaagggagcgtaacggtttagcaagttgaagtgaaagcccggggctcaaccccggtactgctttggaaactgttagacttgagtgcaggagaggtaagtggaattctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggggcaaagcccttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaacaagtttatccngantactctgtgcagagggggcgaaaacggtggagcaagtntgaagtcaacgcgtcgtgagatgttgggttaagtcccgcaacgagcgcaacccttatccttagtagccagcgagtagagtcgggcactctggggagactgccagggataacctggaggaaggtggggatgacgtcaaatcatcatgccccttatgatttgggctacacacgtgctacaatggcgtaaacaaagggaggcaaaggagcgatccggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctg

SEQ ID NO: 591 - DNA, 1393 bp, Clostridium hiranonis
acatgcaagtcgagcgattctcttcggagaagagcggcggacgggtgagtaacgcgtgggtaacctgccctgtacacacggataacataccgaaaggtatgctaatacgggataatatataagagtcgcatgacttttatatcaaagatttttcggtacaggatggacccgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgcaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcaggagttaaaggctacggctcaaccgtagtaagctcctgatactgtctgacttgagtgcaggagaggaaagcggaattcccagtgtagcggtgaaatgcgtagatattgggaggaacaccagtagcgaaggcggctttctggactgtaactgacgctgaggcacgaaagcgtggggagcaaacaggattagataccctggtagtccacgctgtaaacgatgagtactagttgtcggaggttaccccttcggtgccgcagctaacgcattaagtactccgcctggggagtacgcacgcaagtgtgaaactcaaaggaattgacggggacccgcacaagtagcggagcatgtggtttaattcgaagcaacgcgaagaaccttacctaggcttgacatccttctgaccgaggactaatctcctctttccctccggggacagaagtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcctagggctacacacgtgctacaatgggtggtacagagggcagccaagccgtgaggtggagcaaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttggagacacccgaagccgactatctaaccttttgggagaagtcgtccccctcgaatcaatacccc

SEQ ID NO: 592 - DNA, 1460 bp, Clostridium histolyticum
gacgaacgctggcggcgtgcttaacacatgcaagtcgagcgatgaagttcccttcggggaacggattagcggcggacgggtgagtaacacgtgggtaacctgcctcaaagagggggatagcctcccgaaagggagattaataccgcataatatctttttaatgcatgttagaaagattaaaggagcaatccgctttgagatggacccgcggcgcattagctagttggtgaggtaacggctcaccaaggcgacgatgcgtagccgacctgagagggtgatcggccacattgggactgagacacggcccagactcctacgggaggcagcagtggggaatattgcgcaatgggggaaaccctgacgcagcaacgccgcgtgagtgatgaaggtcttcggatcgtaaagctctgtcttcagggacgataatgacggtacctgaggaggaagccacggctaactacgtgccagcagccgcggtaatacgtaggtggcaagcgttgtccggatttattgggcgtaaagcatgcgtaggcggatatttaagtgggatgtgaaatcccggggcttaaccccggtgctgcatttcaaactggatatctagagtgcaggagaggaaagcggaattcctagtgtagcggtgaaatgcgtagatattaggaagaacaccagtggcgaaggcggctttctggactgtaactgacgctgaggcatgaaagcgtgggtagcaaacaggattagataccctggtagtccacgccgtaaacgatgggtactaggtgtcggggtttcaatactccggtgccgcagttaacacattaagtaccccgcctggggagtacgatcgcaagattaaaactcaaaggaattgacgggggcccgcacaagtagcggagcatgtggtttaattcgaagcaacgcgaagaaccttacctgggcttgacatcccgagaatcctgtggaaacataggagtgcccttcggggaactcggtgacaggtggtgcatggttgtcgtcagctcgtgtcgtgagatgttgggttaagtcccgcaacgagcgcaaccctttgttgttagttgctaccattaagttgagcactctagcaagactgcctgggtaaccaggaggaaggtggggatgacgtcaaatcatcatgccccttatgtccagggctacacacgtgctacaatggttggtacagagagaagcaagaccgtgaggtggagccaatctcacaaagccaatctcagttcggattgtaggctgcaactcgcctacatgaagctggagttactagtaatcgcgaatcagaatgtcgcggtgaatgcgttcccgggccttgtacacaccgcccgtcacaccatgagagttggtaacacccgaagtccgtgaggtaaccgtaaggagccagcggccgaaggtgggatcgatgattggggtgaagtcgtaacaggtaaccgtaa

SEQ ID NO: 593 - DNA, 1400 bp, Clostridium hylemonae
tcgaacgaagcaatactgtgtgaagagattagcttgctaagatcagaactttgtattgactgagtggcggacgggtgagtaacgcgtgggcaacctgccttacacagggggataacagctagaaatggctgctaataccgcataagacctcagtaccgcatggtagaggggtaaaaactccggtggtgtaagatgggcccgcgtctgattaggtagttggtagggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtaccgactaagaagccggctaactacgtgccacagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagcttttcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctgatcttgacatccccggcatgaaaagtctgaagtactctttcttcggaacaccggtgacaggtggtgcatggttgtcgtcagctcgtgtcgtgagatgttgggttaagtcccgcaacgagcgcaacccttatctttagtagccagcatttgaggtgggcactctagagagactgccagggataacctggaggaaggtggggatgacgtcaaatcatcatgccccttatgaccagggctacacacgtgctacaatggcgtaaacaaagggaagcgaccctgtgaaggcaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacctaaccgaaaggaaggagccg

SEQ ID NO: 594 - DNA, 994 bp, Clostridium indolis
  modified_base (944)..(944): a, c, t, g, unknown or other
  modified_base (961)..(961): a, c, t, g, unknown or other
cggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttanacaggtggtgcatggtngtcgtcagctcgtgtcgtgagatgttgggttaa

SEQ ID NO: 595 - DNA, 1401 bp, Clostridium innocuum
  modified_base (15)..(16): a, c, t, g, unknown or other
  modified_base (1395)..(1395): a, c, t, g, unknown or other
tcgaacgaagtcttnnggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagngagccg

SEQ ID NO: 596 - DNA, 310 bp, Clostridium irregulare
  modified_base (44)..(44): a, c, t, g, unknown or other
  modified_base (59)..(59): a, c, t, g, unknown or other
  modified_base (265)..(266): a, c, t, g, unknown or other
gacccgcgtctgattagctagttggtaaggtaacggcttaccanggcgacgatcactanccgacctgagagggtgatcggccacattggaactgaaacacggtccaaactcctacgggaggcagcagtggggaatattgcacaatgggcgaaagcctgatgcaccaacgccgcgtgagcgatgaaggccttcgggtcgtaaagctctgtcctcaaggaagataatgacggtacttgaagaggaagccccggctaactacgtgccnncagccgcggtaatacgtagggggctagcgttatccggaattact

SEQ ID NO: 597 - DNA, 1023 bp, Clostridium isatidis
  modified_base (923)..(923): a, c, t, g, unknown or other
  modified_base (940)..(940): a, c, t, g, unknown or other
  modified_base (967)..(967): a, c, t, g, unknown or other
cgaggtgattccttcgggaatgaacctagcggcggacgggtgagtaacacgtgggtaacctgccttatagaggggaatagcctcccgaaagggagattaataccgcataatattgaagcttcgcatgaagtttcaatcaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatactcgggctcaacccgggggctgcatttcaaactgaaagtctagagtgcaggagaggagagtggaattcctagtgtagcggtgaaatgcgtagagattaggaagaacaccagtggcgaaggcggctctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaanccggggaagtcccttcngggacaggatgacaggtggtgcatggntgtcgtcagctcgtgtcgtgagatgttgggttaagtcccgcaacgagcgcaacccc

SEQ ID NO: 598 - DNA, 1462 bp, Clostridium kluyveri
ttaaaataagagtttgatcctggctcaggacgaacgctggcggcgtgcctaacacatgcaagtcgagcgaggaagccccttcgggggtggaatagcggcggacgggtgagtaacacgtgggtaacctgcctcaaagagggggatagcctcccgaaagggagattaataccgcatagaaggtaaaaatcgcatgataaatgccttaaaggagcaatccgctttgagatgggcccgcgtcgcattagctagttggagggataaaagccccccaaggcgacgatgcgtagccgacctgagagggtgaacggccacattggaactgagatacggtccagactcctacgggaggcagcagtggggaatattgcacaatgggggaaaccctgatgcagcaacgccgcgtgagtgaagaaggttttcggatcgtaaagctctgtcatccgggacgataatgacggtaccggaagaggaagccacggctaactacgtgccagcagccgcggtaatacgtaggtggcgagcgttgtccggaattactgggcgtaaagggtgtgcaggcggatatttaagtgagatgtgaaagacccgggcttaacccgggcagtgcatttcaaactggatatctagagtgcaggagaggagaacggaattcctagtgtagcggtgaaatgcgtagagattaggaagaacaccagtggcgaaggcggttctctggactgtaactgacgctgaggcacgaaagcgtgggtagcaaacaggattagataccctggtagtccacgccgtaaacgatgagtactaggtgtagggggtatcgaccccccctgtgccgcagtaaacacaataagtactccgcctgggaagtacgatcgcaagattaaaactcaaaggaattgacggggacccgcacaagcagcggagcatgtggtttaattcgaagcaacgcgaagaaccttacctggacttgacatcccctgaatgactcgtaatggaggaagccctacggggcagggagacaggtggtgcatggttgtcgtcagctcgtgtcgtgagatgttaggttaagtcctgcaacgagcgcaacccctgtcgttagttgccagcacgtaaaggtgggcaccctaacgagactgccgcggttaacgtggaggaaggtggggatgacgtcaaatcatcatgccccttatgtccagggcaacacacgtgctacaatgggcagaacagagagaagcaataccgcgaggaggagcaaatctcaaaaactgcccccagttcggattgcaggctgaaacccgcctgcatgaagttggagttgctagtaatcgcgaatcagcatgtcgcggtgaatacgttcccgggtcttgtacacaccgcccgtcacaccatgagagctggcaacacccgaagtccgtagtctaaccaaggaggacgcggccgaaggtggggttagtgattggggtga

SEQ ID NO: 599 - DNA, 1361 bp, Clostridium lactatifermentans
agagcttcggcaggatttctatctatcttagtggcggacgggtgagtaacgtgtgggcaacctgccctgtactggggaataatcattggaaacgatgactaataccgcatgtggtcctcggaaggcatcttctgaggaagaaaggatttattcggtacaggatgggcccgcatctgattagctagttggtgagataacagcccaccaaggcgacgatcagtagccgacctgagagggtgatcggccacattgggactgagacacggcccaaactcctacgggaggcagcagtggggaatattgcacaatgggcgaaagcctgatgcagcaacgccgcgtgaaggatgaagggtttcggctcgtaaacttctatcaatagggaagaaataaatgacggtacctaaataagaagccccggctaactacggccagcagccgcggtaatactagggggcaagcgttatccggaattactgggtgtaaagggagcgtaggcggcatggtaagccagatgtgaaagccttgggcttaacccgaggattgcatttggaactatcaagctagagtacaggagaggaaagcggaattcctagtgtagcggtgaaatgcgtagatattaggaagaacaccagtggcgaaggcggctttctggactgaaactgacgctgagctcgaaagcgtggggagcaaacaggattagataccctggtagtccacgccgtaaacgatgagtgctaggtgtcggggaggaatcctcggtgccgcagctaacgcaataagcactccacctggggagtacgaccgcgaggttgaaactcaaaggaattgacgggggcccgcacaagcggtggagcatgtggtttaattcgaagcaacgcgaagaaccttaccaaggcttgacatcccgatgaccgctctagagatagagcttctcttcgtagcatcggtgaccgggggtgcatgggagtcgtcagctcgtgtcgtgagatgttgggttaagtcccgcaacgagcgcaacccttatcttcagtagccatcattcagttgggcactctggagagactgccgtggataacacggaggaaggtggggatgacgtcaaatcatcatgccccttatgtcttgggctacacacgtgctacaatggctggtaacaaagtgacgcaagacggcgacgttaagcaaatcacaaaaacccagtcccagttcggattgtagtctgcaactcgactacatgaagctggaatcgctagtaatcgcgaatcagcatgtcgcggtgaatacgttcccgggccttgtacacaccgcccgtcacaccatgggagttggaagcacccgaagtcggtgacctaaccgtaagg

SEQ ID NO: 600 - DNA, 1381 bp, Clostridium lavalense
  modified_base (17)..(19): a, c, t, g, unknown or other
tcgaacgaagcattttnnnatgaagttttcggatggattctgagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcaataagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgca

SEQ ID NO: 601 - DNA, 1505 bp, Clostridium leptum
cgacgctggcggcgtgcctaacacatgcaagtcgaacggagttaaattcgacacccgagtatccggccgggaggcggggtgctgggggttggatttaacttagtggcggacgggtgagtaacgcgtgagtaacctgcctttcagagggggataacgttctgaaaagaacgctaataccgcataacatcaatttatcgcatgataggttgatcaaaggagcaatccgctggaagatggactcgcgtccgattagccagttggcggggtaacggcccaccaaagcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgttcttagtgacgataatgacggtagctaaggagaaagctccggctaactacgtgccagcagccgcggtaatacgtagggagcgagcgttgtccggatttactgggtgtaaagggtgcgtaggcggcgaggcaagtcaggcgtgaaatctatgggcttaacccataaactgcgcttgaaactgtcttgcttgagtgaagtagaggtaggcggaattcccggtgtagcggtgaaatgcgtagagatcgggaggaacaccagtggcgaaggcggcctactgggctttaactgacgctgaagcacgaaagcatgggtagcaaacaggattagataccctggtagtccatgccgtaaacgatgattactaggtgtggggggtctgaccccctccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgtctaacgaagcagagatgcattaggtgcccttcggggaaaggcgagacaggtggtgcatggttgtcgtcagctcgtgtcgtgagatgttgggttaagtcccgcaacgagcgcaacccttgtttctagttgctacgcaagagcactctagagagactgccgttgacaaaacggaggaaggtggggacgacgtcaaatcatcatgccccttatgacctgggccacacacgtactacaatggctgtaaacagagggaagcaaagccgcgaggtggagcaaaaccctaaaagcagtcccagttcggatcgcaggctgcaacccgcctgcgtgaagtcggaattgctagtaatcgcggatcagcatgccgcggtgaatacgttcccgggccttgtacacaccgcccgtcacaccatgggagccggtaatacccgaagccagtagttcaaccgcaaggagagcgctgtcgaaggtaggattggcgactggggtgaagtcgtaacaaggtagccgtatcggaaggtgcggc

SEQ ID NO: 602 - DNA, 1500 bp, Clostridium limosum
tggctcaggacgaacgctggcggcgtgcttaacacatgcaagtcgagcgatgaagcttccttcgggaagtggattagcggcggacgggtgagtaacacgtgggtaacctgcctcaaagagggggatagccttccgaaaggaagattaataccgcataatatcatttcaatgcatgttgaaatgattaaaggagtaatccgctttgagatggacccgcggcgcattagctagttggtgaggtaacggctcaccaaggcgacgatgcgtagccgacctgagagggtgatcggccacattgggactgagacacggcccagactcctacgggaggcagcagtggggaatattgcgcaatgggggaaaccctgacgcagcaacgccgcgtgagtgatgacggtcttcggattgtaaagctctgttttcagggacgataatgacggtacctgaggaggaagccacggctaactacgtgccagcagccgcggtaatacgtaggtggcgagcgttgtccggatttattgggcgtaaagcatgcgtaggcggatacttaagtgggatgtgaaatcccggggctcaaccccggtgctgcattccaaactgggtatctagagtacaggagaggaaagcggaattcctagtgtagcggtgaaatgcgtagagattaggaagaacaccagtggcgaaggcggctttctggactgtaactgacgctgaggcatgaaagcgtgggtagcaaacaggattagataccctggtagtccacgccgtaaacgatgagtactaggtgtcggggtttcaatacttcggtgccgcagttaacacattaagtactccgcctgggaagtacgatcgcaagattaaaactcaaaggaattgacgggggcccgcacaagtagcggagcatgtggtttaattcgaagcaacgcgaagaaccttacctgggcttgacatcccaagaatcctgtggaaacacgggagtgcccttcggggaacttggtgacaggtggtgcatggttgtcgtcagctcgtgtcgtgagatgttgggttaagtcccgcaacgagcgcaacccttgttgttagttgctaccattaagttgagcactctagcaagactgcctgggtaaccaggaggaaggtggggatgacgtcaaatcatcatgccccttatgtccagggctacacacgtgctacaatggttggtacaaagagaagcaagaccgtgaggtggagcaaatctcataaaaccaatctcagttcggattgtaggctgaaactcgcctacatgaagctggagttactagtaatcgcgaatcagaatgtcgcggtgaatgcgttcccgggccttgtacacaccgcccgtcacaccatgagagttggtaacacccgaagtccgtgaggtaaccgcaaggagccagcggccgaaggtgggatcgatgattggggtgaagtcgtaacaaggtagccgtaggagaacctgcggctggatcacctcctttctga

SEQ ID NO: 603 - DNA, 1387 bp, Clostridium magnum
  modified_base (816)..(816): a, c, t, g, unknown or other
ggacgggtgagtaacacgtgggtaacctgcctcaaagagggggatagcctcccgaaagggagattaataccgcataacattagtttttcgcatgaagaactaattaaaggagtaatccgctttgagatggacccgcggcgcattagctagttggtgaggtaaaggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtcttttgggacgataatgacggtaccaaaggaggaagccacggctaactacgtgccagcagccgcggtaatacgtaggtggcgagcgttgtccggatttactgggcgtaaaggtagcgtaggcggatatttaagtgagatgtgaaatacccgagcttaacttgggtagctgcatttcaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgagtactaggtgtaggagggtccaaccttctgtgccgcagttaacacaataagtactccgcctgggaagtacgatcgcaagattaaaactcaaaggaattgacgggggcccgcacaagcanggacatgtggtttaattcgaagcaacgcgaagaaccttacctggacttgacatcccctgaatagtgcagagatgcatgaagcttcgggcaggagacaggtggtgcatggttgtcgtcagctcgtgtcgtgagatgttaggttaagtcctgcaacgagcgcaacccctatcattagttgctaccattaagttgagcactctagtgagactgcccgggttaaccgggaggaaggtggggatgacgtcaaatcatcatgccccttatgccagggctacacacgtgctacaatggtaggtacagagagatgcaagaccgcgaggtggagcaaaactcaaaaacctatcccagttcggattgtaggctgcaactcgcctacatgaagccggagttgctagtaatcgcgaatcagaatgtcgcggtgaatacgttcccgggccttgtacacaccgcccgtcacaccatgagagctggcaacacccgaagtccgtgaggtaaccgtgaaaggagccagcggaaaggtggggttagtgattggggtgaagtcgtaacaaggtagccgtaggactcgctg

SEQ ID NO: 604 - DNA, 1498 bp, Clostridium malenominatum
gtttgatcctggctcaggacgaacgctggcggcgtgcctaacacatgcaagtcgagcgatgatatcccttcggggattgattagcggcggacgggtgagtaacacgtgggtaacctgcctcaaagagggggatagccctccgaaaggaggattaataccgcataaagttgagagttcgcatgaacattcaaccaaaggagcaatccgctttgagatggacccgcgtcccattagctagttggtgaggtaatagctcaccaaggcgacgatgggtagccgacctgagagggtgatcggccacattggaactgagatacggtccagactcctacgggaggcagcagtggggaatattgcgcaatgggggaaaccctgacgcagcaacgccgcgtgggcgacgaaggtcttcggattgtaaagccctgtcttctgggacgataatgacggtaccagaggaggaagccacggctaactacgtgccagcagccgcggtaatacgtaggtggcaagcgttgtccggaattactgggcgtaaagggtgcgtaggcggatatttaagtgggatgtgaaatacctgagctcaactcgggtgctgcattccaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaactatgaatactaggtgtaggggggaacctccctctgtgccgcagttaacacaataagtattccgcctggggagtacggtcgcaagactaaaactcaaaggaattgacgggggcccgcacaagcagcggagcatgtggtttaattcgaagcaacgcgaagaaccttacctgaacttgacatcccctgcattactcgtaatggaggaaatcccttcggggacagggagacaggtggtgcatggttgtcgtcagctcgtgtcgtgagatgttgggttaagtcccgcaacgagcgcaacccttattattagttgctaccattaagttgagcactctaatgagactgcccgggttaaccgggaggaaggtggggatgacgtcaaatcatcatgccccttatgttcagggctacacacgtgctacaatggtgagaacaacgagacgcaagaccgcaaggtggagcaaacctcaaaaactcatcccagttcggattgtaggctgaaactcgcctacatgaagccggagttgctagtaatcgcgaatcagcatgtcgcggtgaatacgttcccgggccttgtacacaccgcccgtcacaccatgagagttggcaacacccgaagtccgtgaggtaaccgtaaggagccagcggccgaaggtggggtcaatgattggggtgaagtcgtaacaaggtagccgtaggagaacctgcggctggatcacctcc

SEQ ID NO: 605 - DNA, 1347 bp, Clostridium mayombei
tcgagcgattctcttcggagaagagcggcggacgggtgagtaacgcgtgggtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggtacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggtgcatggatgtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagcctacttagctaa

SEQ ID NO: 606 - DNA, 1363 bp, Clostridium methylpentosum
ttgttttggtgaagcccttcggggtggaaccggctcaacttagtggcggacgggtgagtaacacgtgagcaacctgccttacagaggggaataacgtttggaaacgaacgctaataccgcataacataacgggatcgcatgattttgttatcaaagattttatcgctgtaagatgggctcgcgtctgattagatagttggtgaggtaatggctcaccaagtcgacgatcagtagccggactgagaggttgaacggccacattgggactgagacacggcccagactcctacgggaggcagcagtggggaatattgcacaatgggggaaaccctgatgcagcgacgccgcgtgaaggaagaaggccttcgggttgtaaacttctgtcttcagggacgataatgacggacctgggggaagctccggctaactacgtgccagcagccgcggtaatacgtagggagcgagcgttgtccggaattactgggtgtaaagggagcgtaggcgggattgcaagttgaatgtgaaatctatgggcttaacccataaactgcgttcaaaactgcagttcttgagtgaagtagaggcaggcggaattcctagtgtagcggtgaaatgcgtagatattaggaggaacaccagtggcgaaggcggcctgctgggctttaactgacgctgaggctcgaaagcgtgggtagcaaacaggattagataccctggtagtccacgctgtaaacgatgattactaggtgtaggggggtcaaccttctgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgaagtagagatacattagacgcccttcggggaaagttgagacaggtggagcatgggcgtcgtcagctcgtgtcgtgagatgttgggttaagtcccgcaacgagcgcaacccttacatttagttgctacgcaagagcactctagatggactgccgttgacaaaacggaggaaggtggggatgacgtcaaatcatcatgccccttatgacctgggctacacacgtactacaatggctattaacagagggaagcaatactgtgaagtggagcaaacccctaaaaatagtctcagttcggattgtaggctgcaactcgcctacatgaagccggaattgctagtaatcgcggatcagcatgccgcggtgaatacgttcccgggccttgtacacaccgcccgtcacaccatgagagttggcaacacccgaagtcagtagtctaaccgc

SEQ ID NO: 607 - DNA, 1392 bp, Clostridium nexile
tcgaacgaagcgcttaaatggatttcttcggattgaagtttttgtgactgagtggcggacgggtgagtaacgcgtgggtaacttgcctcatacagggggataacagttagaaatgactgctaataccgcataagcgcacagtgctgcatggcacagtgtgaaaaactccggtggtatgagatggacccgcgtctgattagctagttggtggggtaacggcctaccaaggcgacgatcagtagccggcctgagagggtgaacggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggttgtgtaagtctgatgtgaaagcccggggctcaaccccgggactgcattggaaactatgtaactagagtgtcggagaggtaagcggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctggtcttgacatcccggtgaccggcaagtaatgttgcctttccttcgggacaccggtgacaggtggtgcatggttgtcgtcagctcgtgtcgtgagatgttgggttaagtcccgcaacgagcgcaacccctatcttcagtagccagcatttaaggtgggcactctggagagactgccagggataacctggaggaaggtggggatgacgtcaaatcatcatgccccttatgaccagggctacacacgtgctacaatggcgtaaacaaagggaagcgaacctgtgaggggaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcagtaacgcccgaagtcagtgacccaaccgtaaggagggagctg

SEQ ID NO: 608 - DNA, 1493 bp, Clostridium novyi
gagagtttgatcctggctcaggacgaacgctggcggcgtgcctaacacatgcaagtcgagcgatgaagcttccttcgggaagtggattagcggcggacgggtgagtaacacgtgggtaacctgcctcaaagagtgggatagcctcccgaaagggagattaataccgcataacattattttacggcatcgtagaataatcaaaggagcaatccgctttgagatggacccgcggcgcattagctagttggtgaggtaacggctcaccaaggcaacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtcattagggacgataatgacggtacctaatgaggaagccacggctaactacgtgccagcagccgcggtaatacgtaggtggcaagcgttgtccggatttactgggcgtaaagagtatgtaggtgggcatttaagtcagatgtgaaattcccgggcttaacctgggagctgcatttgatactgggtgtctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaactgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaatcccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacctgcggct

SEQ ID NO: 609 - DNA, 1391 bp, Clostridium orbiscindens
  modified_base (16)..(16): a, c, t, g, unknown or other
tcgaacggggtgctcntgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccaggtgtgtgtaaccggcgagtgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgc

SEQ ID NO: 610 - DNA, 1342 bp, Clostridium oroticum
cggattgaaagagtgttgcgactgagcggcggacgggtgagtaacgcgtgggtaacctgcctcatacagggggataacagttagaaatgactgctaataccgtataagaccacggtgccgcatggcacagtggtaaaaactccggtggtatgagatggacccgcgtctgattagctagttggtagggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgggggagcgcggatttactgggtgtaaagggagcgtagacggtgatgcaagttgatgtgaaaacccggggctcaaccccgggactgcattggaaactgtgtgactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctgctcttgacatcccgctgagctgtcaaggaagcggacatgccgttgggggtgtggagacaggtggtgcatggttgtcgtcagctcgtgtcgtgagatgttgggttaagtcccgcaacgagcgcaacccttatctttagtagccagcggtcaggccgggcactctagagagactgccagggataacctggaggaaggtggggatgacgtcaaatcatcatgccccttatgagcagggctacacacgtgctacaatggcgtaaacaaagggaggcaatactgtgaagtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgc

SEQ ID NO: 611 - DNA, 1377 bp, Clostridium paraputrificum
gtcgagcgatgaagttccttcgggaacggattagcggcggacgggtgagtaacacgtgggcaacctgccttatagaggggaatagccttccgaaaggaagattaataccgcataagattgtagcttcgcatgaagcagcaattaaaggagcaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatacccgggctcaacctgggtgctgcattccaaactggaaatctagagtgcaggaggggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatctcctgaattaccatgtaatgtgggaagtcccttcggggacaggaagacaggtggtgcatgggtgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggccggtacaacgagatgcaataccgtgaggtggagcaaaactataaaaccggtctcagttcggattgtaggctgaaactcgcctacatgaagctggagttactagtaatcgcgaatcagaatgtcgcggtgaatacgttcccgggccttgtacacaccgcccgtcacaccatgagagttggcaatacccaaagttggtgatctaacccgtaagggaggaagcca

SEQ ID NO: 612 - DNA, 1374 bp, Clostridium perfringens
tcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaggaccattaggggggatgggaaatagccgggctcaacttgggtcagctcgtgtcgtgagatgttgggttaagtcccgcaacgagcgcaacccttgtcgttagttactaccattaagttgaggactctagcgagactgcctgggttaaccaggaggaaggtggggatgacgtcaaatcatcatgccccttatgtgtagggctacacacgtgctacaatggctggtacagagagatgcaataccgcgaggtggagccaaacttaaaaaccagtctcagttcggattgtaggctgaaactcgcctacatgaagctggagttactagtaatcgcgaatcagaatgtcgcggtgaatacgttcccgggtcttgtacacaccgcccgtcacaccatgagagttggcaatacccgaagtccgtgagctaaccgcaaggaggcagcgg

SEQ ID NO: 613 - DNA, 1523 bp, Clostridium phytofermentans
agagtttgatcctggctcaggatgaacgctggcggcgtgcttaacacatgcaagtcgaacggagtttttaaatggaagtcctcggatggaagtttagaaacttagtggcggacgggtgagtaacgcgtgggtaacctgcctcatacagggggataacagtcggaaacgattgctaaaaccgcataacatagcgaaaccgcatgattttgctatcaaatatttataggtatgagatggacccgcgtctgattagctagttggtggggtaatggcctaccaaggcgacgatcagtagccggcttgagagagtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggtaggtcaagtcagatgtgaaagcccagggctcaaccctgggactgcatttgaaactggcttactagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactagctgtcggggctatcatggcttcggtggcgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacaaccgagtaacgtcggtcttccttcgggacagaggtgacaggtggtgcatggttgtcgtcagctcgtgtcgtgagatgttgggttaagtcccgcaacgagcgcaacccctatctttagtagccagcagttcggctgggcactctagagagactgccagggataacctggaggaaggcggggatgacgtcaaatcatcatgccccttatgatttgggctacacacgtgctacaatggtgactacaaagagaagcaagcctgcgagggggagcaaatctcaaaaaggtcatcccagttcggattgtactctgcaactcgagtacatgaagctggaatcgctagtaatcgcgaatcagaatgtcgcggtgaatacgttcccgggtcttgtacacaccgcccgtcacaccatgggagtaggtaacgcccgaagtcagtgacccaaccgtaaggagggagctgccgaaggcgggatctataactggggtgaagtcgtaacaaggtagccgtatcggaaggtgcggctggatcacctccttt

SEQ ID NO: 614 - DNA, 1482 bp, Clostridium piliforme
agagtttgatcatggctcaggatgaacgctggcggcgtgcctaacacatgcaagtcgagcggggatataatagcgttaatcgctaatatattctagcggcggacgggtgagtaacgcgtgggtaacctgccctatacactgggataacatcgagaaatcggtgctaataccggataagctaacagtaaggcatcttatagttagaaaaactgaggtggtataggaggggcccgcgtctgattagctagttggtgtggtaaaagcataccaaggcgacgatcagtagccgacctgagagggtgatcggccacattggaactgagacacggtccaaactcctacgggaggcagcagtggggaatattgcacaatggggggaaccctgatgcagcaacgccgcgtgaaggaagaagtatttcggtatgtaaacttctatcgacagggaagaaaaaaatgacggtacctgaataagaagcaccggctaaatacgtgccagcagccgcggtaatacgtatggtgcaagcgttatccggatttactgggtgtaaagggtgagtaggcggttagataagtcatatgtgaaattctggggctcaactccagcgctgcataagaaactatttaactagagtacaggagaggtaagcggaattcctagtgtagcggtgaaatgcgtagatattaggaagaacaccggtggcgaaggcggcttactggactgaaactgacgctgagtcacgaaagcgtggggagcgaacaggattagataccctggtagtccacgctgtaaacgatgagtgctaggtgttgggaagaaattctcggtgccgcagcaaacgcaataagcactccacctggggagtacgaccgcaaggttgaaactcaaaggaattgacggggacccgcacaagcggtggagcatgtggtttaattcgaagcaacgcgaagaaccttacctaaacttgacataccattgacaggctacgtaaagtagctttccttcggggcaatggatacaggtggtgcatggttgtcgtcagctcgtgtcgtgagatgttgggttaagtcccgcaacgagcgcaacccctattcttagtagccagcactttgggtgggcactctaaggagactgccgtggataacacggaggaaggtggggatgacgtcaaatcatcatgccccttatgtttagggctacacacgtgctacaatggctataacaaagtgaagcgagacagtgatgtggagcaaagcacataaaagtagtcccagttcggattgtagtctgcaactcgactacatgaagttggaatcgctagtaatcgcgaatcagaatgtcgcggtgaatacgttcccgggtcttgtacacaccgcccgtcacaccatgggagttggaagcacccgaagcctgtgacctaaccgtaagggaggagcagtcgaaggtgaagccagtgactggggtgaagtcgtaacaaggtaacc

SEQ ID NO: 615 - DNA, 1487 bp, Clostridium putrefaciens
agagtttgatcctggctcaggacgaacgctggcggcgtgcttaacacatgcaagtcgagcgaagttattccttcgggaataacttagcggcggacgggtgagtaacacgtgggtaacctgcctcatagagggggatagccttccgaaaggaagattaataccccataacatagcattatcgcatgataaagttattaaaggagtaatccgctatgagatggacccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgatgaaggccttcgggtcgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgtgggagaggaaagtggaattcctagtgtagcggtgaaatgcgtagatattaggaagaacaccagtggcgaaggcgactttctggaccataactgacgctgaggctcgaaagcgtggggagcaaacaggattagataccctggtagtccacgccgtaaacgatggatactaggtgtgggggataccaatcctccgtgccgtcgttaacacactaagtatcccgcctggggagtacgatcgcaagattaaaactcaaaggaattgacgggggcccgcacaagcagcggagcatgtggtttaattcgaagcaacgcgaagaaccttacctagacttgacatctcctgaattacctgtaattagggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccaggaggaaggtggggatgacgtcaaatcatcatgccccttatgtctagggctacacacgtgctacaatggcgagtacaacgagacgcaataccgcgaggtggagcaaaactcaaaaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgtgctaacgcgtaagcgaggcagcggccgaaggtagggtcagcgattggggtgaagtcgtaacaaggtagccgtagaagaacctgc

SEQ ID NO: 616 - DNA, 1477 bp, Clostridium quinii
tttatcctgactcagacgaacgcttggcggcgtgcctaacacatgcaagtcgagcgaggagattccttcgggatgatcctagcggcggacgggtgagtaacacgtgggcaacctgcctcatagagaggaatagcctcccgaaagggagattaatacctcataacattgcagtttgcatgggacagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcaagcgttgtccggatttactgggcgtaaagggagcgtaggcggacttttaagtgagatgtgaaatacccgggctcaacctgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcgatgacctctgtgccgccgtaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcttcagacagggaagacaggttgtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttggtggtctaacctgaaggaggaagccacctaaggtagggtcagcgattggggtgaagtcgtaacaaggtagccgtagagaaccttg

SEQ ID NO: 617 - DNA, 1040 bp, Clostridium ramosum
  modified_base (7)..(9): a, c, t, g, unknown or other
  modified_base (12)..(12): a, c, t, g, unknown or other
  modified_base (18)..(18): a, c, t, g, unknown or other
  modified_base (20)..(20): a, c, t, g, unknown or other
  modified_base (22)..(22): a, c, t, g, unknown or other
  modified_base (27)..(27): a, c, t, g, unknown or other
  modified_base (31)..(31): a, c, t, g, unknown or other
  modified_base (43)..(43): a, c, t, g, unknown or other
gcgtgannngangttttngntntaaantctntataaaggaagnacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaa

SEQ ID NO: 618 - DNA, 1505 bp, Clostridium rectum
gagagtttgatcctggctcaggatgaacgctgacagaatgcttaacacatgcaagtctagcttgatccttcgggtgatggtggcggacgggtgagtaacgcgtaaagaacttgccctgcagtctgggacaacatttggaaacgaatgctaataccggatattatgtgagtttcgcatgaaattcatatgaaagctatatgcgctgcaggagagctttgcgtcctattagctagttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagttttcggaatgtaaagtgctttcagttgggacgaagtaagtgacggtaccaacagaagaagcgacggctaaatacgtgccagcagccgcggtaatacgtatgtgcaagcgttatccggatttattgggcgtaaagcgcgtcgtaggcggtttggtaagtctgatgtgaaaatgcggggctcaactccgtattgcgttggaaactgtccaaactagagtactggagaggtgggcggaactacaagtgtagaggtgaaattcgtagatatttgtaggaatgccgatggggaagccagcccactggacagatactgacgctaaagcgcgaaagcgtgggtagcaaacaggattagataccctggcctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaaattagcagagatgcttttgtgccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgatcagcaggaggaaggtggggatgacgtcaagtcatcatgccccttatacgctgggctacacacgtgctacaatgggtagtacagagagtcgcaaacctgcgagggggagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggctggatcacctcctt

SEQ ID NO: 619 - DNA, 1326 bp, Clostridium saccharogumia
gagtttgatcctggctcaggatgaacgctggcggcgtgcctaatacatgcaagtcgaacgagtggcgaacgggtgagtaagacataagtaacctgccctttacagggggataactattggaaacgatagctaagaccgcatagtaaaactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaggaaggtcttcggactgtaaacttctgttataaaggaagatgacggtactttatgaggaagccacggctaactacgtgccagcagccgcggtaatacgtaggtggcaagcgttatccggaattattgggcgtaaagagggagcaggcggcagcaagggtctgtggtgaaagactgaagcttaacttcagtaagccatagaaaccgggcagctagagtgcaggagaggatcgtggaattccatgtgtagcggtgaaatgcgtagatatatggaggaacaccagtggcgaaggcgacgatctggcctgactgacgctcagtcccgaaagcgtggggagcaaataggattagataccctagtagtccacgccgtaaacgatgagtactaagtgttgggatctcagtgctgcagttaacgcagtaagtactccgcctgagtagtacgttcgcaagaatgaaactcaaaggaattgacgggggcccgcacaagcggtggagcatgtggtttaattcgaagcaacgcgaagaaccttaccaggtcttgacatatacaggtggtgcatggttgtcgtcagctcgtgtcgtgagatgttgggttaagtcccgcaacgagcgcaacccttatcgttagttaccatcatggggactctagcgagactgccagtgacaagctggaggaaggcggggatgacgtcaaatcatcatgccccttatgacctgggctacacacgtgctacaatggatggcagagggaagcgaagccgcgaggtggagcgaaacccagccattctcagttcggatgtagtctgcaactcgactacagaagttggaatcgctagtaatcgcgaatcagcatgtcgcggtgaatacgttctcgggccttgtacacaccgcccgtcacaccatgagagttgataacacccgaagccggtgcctagggagctgtctaaggtgggattgatgattggggtgaagtcgtaacaagg

SEQ ID NO: 620 - DNA, 1519 bp, Clostridium saccharolyticum
agagttcgatcctggctcaggatgaacgctggcggcgtgcttaacacatgcaagtcgagcgaagcacttttaaggaagttttcggatggaattaaaagtgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacct

SEQ ID NO: 621 - DNA, 1519 bp, Clostridium sardiniense
tttaaattgagagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagccttccgaaaggaagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcaagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttcgatacctctgtgccgccgctaacgcattaagtattccgcctggggagtacggtcgcaagatcaaaactcaaaggaattgacgggggcccgcacaagtagcggagcatgtggtttaattcgaagcaacgcgaagaaccttacctagacttgacatcttctgcattacccttaatcggggaagtcctttcggggacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttct

SEQ ID NO: 622 - DNA, 1470 bp, Clostridium sartagoforme
ggctcaggacgaacgctggcggcgtgcctaacacatgcaagtcgagcgaggagattcccttcggggatgaacctagcggcggacgggtgagtaacacgtgggcaacctgccttatagaggggaatagccttccgaaaggaagattaataccgcataacattacattttcgcatgaagaagtaattaaaggagtaatccgctataagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaggaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctaccattaagttgagcactctagcaagactgcccgggttaaccgggaggaaggtggggatgacgtcaaatcatcatgccccttatgtctagggctacacacgtgctacaatggcaagtacaaaaagatgcaataccgcaaggtggagctaaacttaaaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgacctaaggtagggtcagcgaatggggtgaagtcgtaacaaggtagccgtagga

SEQ ID NO: 623 - DNA, 1529 bp, Clostridium scindens
gagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattttggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagttggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttc

SEQ ID NO: 624 - DNA, 1507 bp, Clostridium septicum
agagtttgatcatggctcaggacgaacgctggcggcgtgcctaacacatgcaagtcgagcgaggggagtttcttcggaaacaaacctagcggcggacgggtgagtaacacgtgggcaacctgccttgtagaggggaatagcctcccgaaagggagattaataccgcataacattgcagcttcgcatggagcagcaattaaaggagtaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacctgggggctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatggatactaggtgtgggaggtatcaactccttccgtgccgccgttaacacattaagtatcccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcccttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaacgagatgcaataccgygaggtggagctaaactataaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctt

SEQ ID NO: 625 - DNA, 1364 bp, Clostridium sordellii
  modified_base (12)..(12): a, c, t, g, unknown or other
gtcgagcgatcncttcggagagagcggcggacgggtgagtaacgcgtgggtaacctgccctgtacacacggataacataccgaaaggtatactaatacgggataacatatgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgacaggtggagcatggaagtcgtcagctcgtgtcgtgagatgttgggattagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaagccgcgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatggaagttgggggcgcccgaagccggttagctaaccttttaggaagcggccg

SEQ ID NO: 626 - DNA, 1378 bp, Clostridium sp. 7_2_43FAA
tcgagcgagaggagttccttcgggaacaaatctagcggcggacgggtgagtaacacgtgggcaacctgccttgtagaggggaatagccttccgaaaggaagattaataccgcataatattacattttcgcatgaagaagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggtcttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggaccatgtggtttaattcgaagcaacgcgaagaaccttacctagacttgacatctcctgcattactcttaatcgaggaagtcctttcggggacaggatgacaggtgctgcatgttaaactggaagtctagagtgcaggagtggggtgaggacctccaagtagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcgac

SEQ ID NO: 627 - DNA, 1390 bp, Clostridium sp. D5
  modified_base (1252)..(1252): a, c, t, g, unknown or other
  modified_base (1302)..(1302): a, c, t, g, unknown or other
tcgagcgaagcgctttacttagatttcttcggattgaagagtgttgcgactgagcggcggacgggtgagtaacgcgtgggtaacctgcctcatacagggggataacagttagaaatgactgctaataccgcataagaccacagtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttatttcaaagcaacgcgaagaatcttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggttacacacgtgctacaatggcgtaaacaaagggaggcaatcccgcgaggttgagcaaatcccaaaaataacgtttcacttcggatcgtagtgtgcaactngattacacgaagctggcattcatagtaatcgggaatcagaatgtcgcggngaatacgttcccgggtcttgtacacaccgcccgtcacaccatgggagttggtaacgcccgaagtcagtgacccaaccgtaaggaggga

SEQ ID NO: 628 - DNA, 1381 bp, Clostridium sp. HGF2
  modified_base (15)..(15): a, c, t, g, unknown or other
tcgaacgaagtttcnaggaagcttgcttccaaagagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaaaaccttaccaggccttgacatggaaaccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgt

SEQ ID NO: 629 - DNA, 1274 bp, Clostridium sp. HPB-46
agtcgagcgggaaacttcggtttccagcggcggacgggtgagtaacacgtgggcaacctgcctcacaatgagggatagccttccgaaaggaagattaatacctcataacacaagagaaacgcatgtttctcttgccaaagaatttcgttgtgagatgggcccgcggcgcattagcttgttggtgaggtaacggctcaccaaggctgcgatgcgtagccgacctgagagggtgatcggccacattggaactgagacacggtccagactcctacgggaggcagcagtggggaatattgcacaatggaggaaactctgatgcagcaacgccgcgtgagtgatgaaggtcttcggattgtaaagctctgtcttctgggacgataatgacggcaccagaggaggaagccacggctaactacgtgccagcagccgcggtaatacgtaggtggcaagcgttgtccggatttactgggcgtaaaggatgtgtaggcggatatttaagtgagatgtgaaatccccaggctcaacttgggggctgcatttcaaactggatatctagagtgcaggagaggaaagcggaattcctagtgtagcggtgaaatgcgtagagattaggaagaacatcagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacggtcgcaagattaaaactcaaaggaattgacgggggcccgcacaagcagcggagcatgtggtttaattcgaagcaacgcgaagaaccttacccagacttgacatctcctgaattaatcgtaattgatgaaatcccttcggggacaggaagacaggtggtgcatggttgtcgtcagctcgtgtcgtgagatgttgggttaagtcccgcaacgagcgcaacccttatcattagttgctaacattaagttgagcactctagtgagactgcccgggttaaccgggaggaaggtggggatgacgtcaaatcatcatgccccttatgtctggggctacacacgtgctacaatggtgggaacaaagagatgcaataccgcaaggtggagccaaacttcaagacccatcccagttcggattgtaggctgaaactcgcctacatgaagctggagtgtagtaatcgcgaatcagagtgtagcggtgaa

SEQ ID NO: 630 - DNA, 1358 bp, Clostridium sp. JC122
cgatgaagctccttcgggagtgaattagcggcggacgggtgagtaacacgtgggtaacctgcctcatagaggggaatagccttccgaaagggagattaataccgcataacatagcactaccgcatggtagagttatcaaaggagcaatccgctatgagatggacccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgaagaaggccttagggttgtaaagctctgtcatatgggaagataatgacggtaccataagaggaagccacggctaactacgtgccagcagccgcggtaatacgtaggtggcgagcgttgtccggatttactgggcgtaaaggatgcgtaggcggatatttaagtgggatgtgaaatccccgagcttaactcgggggctgcattccaaactggatatctagagtgtcggaggggaaagtggaattcctagtgtagcggtgaaatgcgtagagattaggaagaacaccagtggcgaaggcgactttctggacgataactgacgctgaggcatgaaagcgtggggagcaaacaggattagataccctggtagtccacgccgtaaacgatgaatactaggtgtaggaggtatcgactccttctgtgccgcagttaacacattaagtattccgcctggggagtacgatcgcaagattaaaactcaaaggaattgacgggggcccgcacaagcagcggagcatgtggtttaattcgaagcaacgcgaagaaccttacctagacttgacatctcctgcattactcttaacagaggaagtccttcgggacaggatgacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtaggtacaacaagatgcaataccgtgaggtggagctaaactcaaaaacctatcccagttcggattgtaggctgaaactcgcctacatgaagccggagttgctagtaatcgcgaatcagcatgtcgcggtgaatacgttcccgggccttgtacacaccgcccgtcacaccatgagagccgataacacccgaagtccgtgaggtaaccgtaagg

SEQ ID NO: 631 - DNA, 1345 bp, Clostridium sp. L2-50
cttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagggacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaaccggaattttccttcgggacagcagagacaggtggggcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgc

SEQ ID NO: 632 - DNA, 1464 bp, Clostridium sp. LMG 16094
gacgaacgctggcggcgtgcctaacacatgcaagtcgagcgaggggagttcttcggaacaaacctagcggcggacgggtgagtaacacgtgggcaacctgcctcaaagaggggaatagcctcccgaaagggagattaataccgcataaagttattttttcgcatgaagagataaccaaaggagcaatccgctttgagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagcgatgaaggtcttcggattgtaaagctctgtcttttgggacgataatgacggtaccaaaggaggaagccacggctaactacgtgccagcagccgcggtaatacgtaggtggcaagcgttgtccggatttactgggcgtaaagagtatgtaggcggacatttaagtcagatgtgaaattcccgggcttaacctgggagctgcatttgatactgggtgtctagagtgcaggagaggaaagtggaattcctagtgtagcggtgaaatgcgtagagattaggaagaacaccagtggcgaaggcgactttctggactgtaactgacgctgagatacgaaagcgtggggagcaaacaggattagataccctggtagtccacgccgtaaacgatgaatactaggtgtcggagggtaccaccttcggtgccgcagcaaacgcaataagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaacagaggaagcccttcggggcaggaagacaggtggtgcatggttgtcgtcagctcgtgtcgtgagatgttgggttaagtcccgcaacgagcgcaacccctattgttagttgctaccattaagttgagcactctagcaagactgcctgggttaaccaggaggaaggtggggatgacgtcaaatcatcatgscccttatgtctagggctacacacgtgctacaatggtcggtacaaaaagatgcaaacccgtgagggggagctaaacttaaaaaccgatcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgwaaggagccagcggtcgaaggtgggattggtgattggggtgaagtcgtaacaaggtagccgtaggagaacctgc

SEQ ID NO: 633 - DNA, 1045 bp, Clostridium sp. M62/1
  modified_base (967)..(968): a, c, t, g, unknown or other
  modified_base (977)..(977): a, c, t, g, unknown or other
  modified_base (984)..(985): a, c, t, g, unknown or other
  modified_base (1010)..(1010): a, c, t, g, unknown or other
  modified_base (1014)..(1015): a, c, t, g, unknown or other
aacgaagcggtttagcggaagttttcggatggaagttaaactgactgagtggcggacgggtgagtaacgcgtgggtaacctgcctcacacagggggacaacagctagaaatggctgctaataccgcataagcgcacagcttcgcatgaagcagtgtgaaaaactccggtggtgtgagatggacccgcgtctgattagctggttggtgaggtaacggctcaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagagaatgacggtacctgactaagaagccccggctaactacgtgccagcagccgcggtaatacgtagggggcaagcgttatccggatttactgggtgtaaagggagcgtagacggcttagcaagtctgaagtgaaagcccggggctcaaccccgggactgctttggaaactgttaagctggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttggtgggcaaagcccatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttctcttcggagcagtggnnacaggtggngcatggnngtcgtcagctcgtgtcgtgagatgntggnnaagtcccgcaacgagcgcaacccttatcct

SEQ ID NO: 634 - DNA, 935 bp, Clostridium sp. MLG055
  modified_base (776)..(776): a, c, t, g, unknown or other
  modified_base (890)..(891): a, c, t, g, unknown or other
  modified_base (893)..(893): a, c, t, g, unknown or other
  modified_base (895)..(895): a, c, t, g, unknown or other
  modified_base (910)..(912): a, c, t, g, unknown or other
acttagtggcgaacgggtgagtaacacgtagataacctgcctgtatgaccgggataacagttggaaacgactgctaataccggataggcagagaggaggcatctcttctctgttaaagttgggatacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaatangttctccgcctgggggagtatgcacgcaagtgtgaaactcaaaggaattgacgggggcccgcacaagcggtggagtatgtggtttaattcgacgcaacgcgaagaaccttaccnngncntgacatggtatcaannncctagagatagggagatagttat

SEQ ID NO: 635 - DNA, 1364 bp, Clostridium sp. MT4 E
catgcacgtcgagcgactcttctggagagagcggcggacgggagagcacgcgagggtacctgccctgtcacacggataacactaccgaaaggtatactaatacggggactaacatactgaaagtcgcatggcttttgtatcaaagctccggcggtacaggatggacccgcgtctgattagctagttggtaaggtaatggcttaccaaggcaacgatcagtagccgaccttgagaagggtgaatcgggccactactggaaatgaagacacgggtccaagactcctactggggaggcagcagtggggaatattgcacaatgggcgaaagcctgatgcagcaacgccgcgtgagcggatgaaggccttcgggtcgtaaagctctgtcctcaaggaagataatgacgggtactttgaggaggaagccccgggctaactacgtgccagcagccgcgggtaatacggtagggggctagcgttatccgggaaattactgggcgtaaagggtgcggtaaggtggtttttttaagtcagaagtgaaaggctacggctcaaccggtagtaagctttttgaaactagagaactttgagtgcaggagaggagagtagaattcctagtgtagcggtgaaatgcgtaaatttaggaggaataccagtagcgaaggcggcttctctggacttgtaactgacactgaggccgaaagcgggggagcaacaggattagatccctggtagtcccgccgtaaacgatgagtactagggtgtcgggggttacccccctcggtgccgcagctaacgcattaagtactccgcctgggaagtacgctcgcaagagtaaactcaaaggaattgaccgggacccgcacaaagtagcggagcatgtggtttaattcgaagcaaacgcgaagaaccttacctaagcttgacatcccactgacctctccctaaatcggagatttcccttcggggccagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacaccaccgtgctacaatgggtggtacagagggttgccaagccgcgaaggtggagctaatcccttaaagccattctcagttcggattgtaggctgaaactcgcctacatgaagctggagttactagtaatcgcaatcagaatgctgcggtgatgcgttcccgggtcttgtacacaccgcccgtcacaccattggaagttggggcgccaga

SEQ ID NO: 636 - DNA, 1205 bp, Clostridium sp. NMBHI-1
aaagggagattaataccgcataatgtatgagaatcgcatgatttttgtaccaaaggagcaatccgctatgagatggacccgcggcgcattagctagttggtgaggtaaaggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgtcatatgggaagataatgacggtaccatatgaggaagccacggctaactacgtgccagcagccgcggtaatacgtaggtggcaagcgttgtccggatttactgggcgtaaaggatgcgtaggcggacatttaagtcagatgtgaaatacccgggctcaacttgggtgctgcatttgaaactgggtgtctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgaccccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggttggtacaataagatgcaataccgcgaggtggagctaaacttataaaaccaatcccagttcggattgtaggctgaaactcgcctacatgaagccgggagttgctagtaatcgcgaatcagcatgtcgcggtgaatacgttcccgg

SEQ ID NO: 637 - DNA, 1389 bp, Clostridium sp. NML 04A032
tcgacggggtgcctatgatagaggattcgtccaattgattaggctacctagtggcggacgggtgagtaacgcgtgagtaacctgccttggagtggggaataacagtccgaaaggactgctaataccgcatgatgcagcgaggtcgcatggccttgctgccaaagatttatcgctctgagatggactcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctctcgggttgtaaacttcttttatcagggacgaaagaaatgacggtacctgatgaataagccacggctaactacgtgccagcagccgcggtaatacgtaggtggcaagcgttatccggatttactgggtgtaaagggcgtgtaggcgggaaagcaagtcaggcgtgaaaactatgggctcaacccatagcctgcgtttgaaactgtttttcttgagtgtcggagaggcaatcggaattccgtgtgtagcggtgaaatgcgtagatatacggaggaacaccagtggcgaaggcggattgctggacgataactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcgtactaacgaagcagacatgcattagatgcccttcggggaaagtatagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggcggtcaacagagggaggcaataccgcgaggtggagcaaatccctaaaagccgtcccagttcggattgcaggctgaaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgc

SEQ ID NO: 638 - DNA, 1031 bp, Clostridium sp. SS2/1
  modified_base (16)..(16): a, c, t, g, unknown or other
  modified_base (26)..(27): a, c, t, g, unknown or other
cgtgagtgaagaagtnttctcggtanntaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactagagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacttttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggag

SEQ ID NO: 639 - DNA, 1375 bp, Clostridium sp. SY8519
tttatggagtttgatcctggctcaggatgaacgctggcggcgtgcctaacacatgcaagtcgaacgagtggcggacgggtgagtaacgcgtggataacctgcctcaaacagggggataacagccggaaacggctgctaataccgcataagaaaaagtggtttgagatggatccgcgtctgattagttagttggcggggtaacggcccaccaaggcgacgatcagtagccggcctgagagggtgaacggccacattgggactgagacacggcccagactcctacgggaggcagcagtggggaatattgcacaatgggggaaaccctgatgcagcaacgccgcgtgagcgaagaagtatttcggtatgtaaagctctatcagcagggaagatgacggtacctgactaagaagctccggctaaatacgtgccagcagccgcggtaatacgtatggagcaagcgttatccggatttactgggtgtaaagggagcgcaggcggtggcgcaagtctgatgtgaaaacccggggcccaaccccgggactgcattggaaactgcgtgacttgagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgttggcatgtcagtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccttgtgtatagtagccagcggccgggcactctatacagactgccagggacaacctggaggaaggcggggatgacgtcaaatcatcatgccccttatggcctgggcgacacacgtgctacaatggcgtacagagggaggcaaagccgcgaggtggagcgaatcccaaaacgtctcagttcggatgcaggctgcaacccgcctgcagaagctggaatcgctagtaatcgcagatcagcatgctgcggtgaatacgttcccgggtcttgtacacaccgcccgtcacaccatgggagtcggaaatgcccgaagccggtacccagggagccgtcgaaggcaggtctgataactggggtgaagtcgtaacaaggtagccgtatcggaaggtgcggctggatcacctcctttct

SEQ ID NO: 640 - DNA, 1267 bp, Clostridium sp. TM-40
acatgcaagtcggacgagtggcgaacgggtgagtaagacataagcaacctgcccctgtgagggggataactgctggaaacggcagctaagaccgcatagtaaattagcacagggatgggcttatgacgcattagccagctggtgaggtaacggctcaccagggcgacgatgcgtagccggcctgagagggtggacggccacactgggactgagacacggcccagactcctacgggaggcagcagtagggaattttcggcaatgggcgaaagcctgaccgagcaacgccgcgtgaaggaagaagtcattcgtgatgtaaacttctgttatgaaggaagatgacggtacttcatgaggaagccacggctaactacgtgccagcagccgcggtaatacgtaggtggcgagcgttatccggaatcattgggcgtaaagagggagcaggcggcagtgcaggtctgcggtgaaagaccggagctaaacttcggtaagccgtggaaaccgcacagctagagagcatcagaggatcgcggaattccatgtgtagcggtgaaatgcgtagatatatggaggaacaccagtggcgaaggcggcggtctggggtggctgacgctcagtcccgaaagcgtggggagcaaataggattagataccctagtagtccacgccgtaaacgatgagtgctaagtgttggggcctcagtgctggagttaacgcaataagcactccgcctgagtagtacgttcgcaagaatgaaactcaaaggaattgacgggggcccgcacaagcggtggagcatgtggtttaattcgaagcaacgcgaagaaccttaccaggtcttgacatgcacaggtggtgcatggttgtcgtcagctcgtgtcgtgagatgttgggttaagtcccgcaacgagcgcaacccctgttgccagttgccagcatggggactctggcgagactgcctctgcaaggaggaggaaggcggggatgacgtcaaatcatcatgccccttatgacctgggctacacacgtgctacaatggacggcagagggaggcgaagccgcgaggtggagcgaaacccagccgttcacagttcggatgcagtctgcaactcgactgcagaagctggaatcgctagtaatcgcgaatcagcatgtcgcggtgaatacgttctcgggccttgtacacaccgcccgtcacaccatgagagttggtaacacccgaagccggtgcccagggagctgtctaaggtgggactgatgattggggtg

SEQ ID NO: 641 - DNA, 1320 bp, Clostridium sp. YIT 12069
gacgaacgctggcggcgtgcctaacacatgcaagtcgaacgagtggcggacgggtgagtaacgcgtgagcaacctgcctcaaagagggggataacgtctggaaacggacgctaataccgcatgaccaaagccgctttgagatgggctcgcgtctgattagctagttggtggggtaaaggcctaccaaggcgacgatcagtagccggactgagaggttgaacggccacattgggactgagacacggcccagactcctacgggaggcagcagtgggggatattgcacaatgggggaaaccctgatgcagcaacgccgcgtgaaggaagacggttttcggattgtaaacttctgttcttagtgacgatgacggtagctaaggagaaagctccggctaactacgtgccagcagccgcggtaatacgtagggagcgagcgttgtccggaattactgggtgtaaagggagcgtaggcgggagatcaagtcagatgtgaaaactatgggctcaacccataacctgcatttgaaactgttcttcttgagtgaagtagaggcaggcggaattccgagtgtagcggtgaaatgcgtagatattcggaggaacaccagtggcgaaggcggcctgctgggcttactgacgctgaggctcgaaagcatggggagcaaacaggattagataccctggtagtccatgccgtaaacgatgattactaggtgtggggtattccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgacaggtggtgcatggttgtcgtcagctcgtgtcgtgagatgttgggttaagtcccgcaacgagcgcaacccttgtcattagttgctacagcactctaatgagactgccgttgacaaaacggaggaaggtggggacgacgtcaaatcatcatgccccttatgacctgggctacacacgtactacaatggccgtcagagggaagcaatactgtgaagtggagcaaacccctacggtcccagttcagatgcaggctgcaacccgcctgcagaagtcggaattgctagtaatcgcggatcagcatgccgcggtgaatacgttcccgggccttgtacacaccgcccgtcacaccatgggagccggtaatacccgaagtcggtgtctaggacgccgccgaaggtaggattggcgactggggtgaagtcgtaacaaggtagccgtatcggaagg

SEQ ID NO: 642 - DNA, 1319 bp, Clostridium sp. YIT 12070
gacgaacgctgtcggcgcgcctaacacatgcaagtcgaacgagtggcggacgggtgagtaacgcgtgagtaacctgcctttcagagggggataacgtctggaaacggacgctaataccgcataaccaaagccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgagtgagggaagaaggttttcggattgtaaacctctgtccttggtgaagatgacggtaaccaaggaggaagctacggctaactacgtgccagcagccgcggtaatacgtaggtagcgagcgttgtccggaattactgggtgtaaagggagcgtaggcgggattgcaagttgaatgttaaatctatgggctcaacccatagccgcgttcaaaactgcagttcttgagtgaagtagaggcaggcggaattcctagtgtagcggtgaaatgcgtaaatattaggaggaacaccagtggcgaaggcggcctgctgggcttactgacgctgaggctcgaaagcgtgggtagcaaacaggattagataccctggtagtccacgctgtaaacgatgattactaggtgtgggggcttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcgacaggtggtgcatggttgtcgtcagctcgtgtcgtgagatgttgggttaagtcccgcaacgagcgcaacccttacgtttagttgctacagcactctagacggactgccgttgacaaaacggaggaaggtggggatgacgtcaaatcatcatgccccttatgacctgggctacacacgtactacaatggctatcagagggaagcaagatggtgacatggagcaaacccctatagtctcagttcggatgcaggctgcaacccgcctgcagaagccggaattgctagtaatcgcggatcagcatgccgcggtgaatacgttcccgggccttgtacacaccgcccgtcacaccatgagagttggcaacacccgaagccgatgtctaggacgtcgtcgaaggtggggttgatgattggggtgaagtcgtaacaaggtagccgtatcggaagg

SEQ ID NO: 643 - DNA, 1522 bp, Clostridium sphenoides
  modified_base (1)..(7): a, c, t, g, unknown or other
  modified_base (1455)..(1455): a, c, t, g, unknown or other
  modified_base (1513)..(1514): a, c, t, g, unknown or other
nnnnnnngagagtttgatcctggctcaggacgaacgctggcggcgtgcttaacacatgcaagtcgagcgaagcgattcaaatgaagtttcggacggattttgaattgacttagcggcggacgggtgagtaacgcgtgggtaacctgcctcatacagggggataacagtcggaaacgactgctaataccgcataacacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccggactgctttggaaactgtggtgctagagtgcaggagaggtaagtggaattcctagtgtagcggtgaaatgcgtagatattaggaggaacaccagtggcgaaggcggcttactggactgtaactgacgttcgaggctcgaaagcgtggggagcaaacaggattagataccctggtagtccacgccgtaaacgatgaatactaggtgttggggagcaaagctcttcggtgccgccggtaacgcaataagtattccacctggggagtacgttcgcaagaatgaaactcaaaggaattgacggggaccgcacaagcggtggagcatgtggtttaattcgaagcaacgcgaagaccttaccaagtcttgacatcggaatgaccgggatgtaacgatcccttcccttcggggcatccagacaggtggtgcatggttgtcgtcagctcgtgtcgtgagatgttgggttaagtcccgcaacgagcgcaacccttatccttagtagccagcaagtcaagctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgangggactgataactggggtgaagtcgtaacaaggtagccgtatcggaaggtgcggctgnntcacctcc

SEQ ID NO: 644 - DNA, 1367 bp, Clostridium spiroforme
  modified_base (41)..(42): a, c, t, g, unknown or other
agcaatgctcgagtggcgaacgggtgagtaatacataagtnncctgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctgtggtgaaagactgaagcttaacttcagtaagccatagaaaccgggctgctagagtgcaggagaggatcgtggaattccatgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggcccgcacaagcggtggagcatgtggtttaattcgaagcaacgcgaagagcgttaccaggtcttgacatccggatgaagacctcataaatgagggcttcagtaagccatagaaaccgggctgctggagtccagcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggag

SEQ ID NO: 645 - DNA, 1516 bp, Clostridium sporogenes
ttaaaattgagagtttgatcctggctcaggacgaacgctggcggcgtgcttaacacatgcaagtcgagcgatgaagcttccttcgggaagtggattagcggcggacgggtgagtaacacgtgggtaacctgcctcaaagtgggggatagccttccgaaaggaagattaataccgcataacataagagaatcgcatgattttcttatcaaagatttattgctttgagatggacccgcggcgcattagctagttggtaaggtaacggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccccctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttct

SEQ ID NO: 646 - DNA, 1400 bp, Clostridium sporosphaeroides
  modified_base (1)..(2): a, c, t, g, unknown or other
  modified_base (832)..(832): a, c, t, g, unknown or other
  modified_base (836)..(836): a, c, t, g, unknown or other
  modified_base (862)..(862): a, c, t, g, unknown or other
  modified_base (922)..(922): a, c, t, g, unknown or other
  modified_base (926)..(926): a, c, t, g, unknown or other
  modified_base (1141)..(1141): a, c, t, g, unknown or other
  modified_base (1169)..(1169): a, c, t, g, unknown or other
  modified_base (1272)..(1274): a, c, t, g, unknown or other
  modified_base (1278)..(1278): a, c, t, g, unknown or other
  modified_base (1293)..(1293): a, c, t, g, unknown or other
  modified_base (1375)..(1375): a, c, t, g, unknown or other
  modified_base (1380)..(1381): a, c, t, g, unknown or other
nntgaacttagcttagtggcggacgggtgagtaacgcgtgagtawcctgcctttcrgagggggatamcgttcctgaaaacaacgctaataccgcataatatattggtgtcgcatggcaccggtatcaaaggagcaatccgctgcaagatggactcgcgtccgatyagccagtkgatkgggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctctttaagtcgggcgtgaaagctgtgggcttaacccacaaattgcgttcgaaactggagggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacnagcngtggagtatgtggtttaattcgaagnaacgcgaagaaccttaccaggtgttgacatccaactaacgaggcagagatgcattaggtngctncggggaaagttgagacaggtggtccatggttgtcgtcagctcgtgtcgtgagatgttgggttaagtcccgcaacgagcgcaacccttgtgattagttstacgcaagagcactctaatcagactgccgttgacaaaacggaggaaggtggggacgacgtcaaatcatcatgccccttatgacctgggctacacacgtactacaatggtcgccaacngagggaagccaagccgcgaggtggagcnaacccccaaaagcgatctcagttcggattgtaggctgcaacccgcctacatgaagttggaattgctagtaatcgcggatcagcatgccgcggcgaatacgttnnngggncttgtacacaccgcncgtcacaccatgggagccggtaatacccgaagccaatagtctaaccgcaaggaggacgttgtcgaaggtaggattggcgacnggggnnaagtcgtaacaaggtaacc

SEQ ID NO: 647 - DNA, 1518 bp, Clostridium stercorarium
tgatcctggctcaggacgaacgctggcggcgtgcctaacacatgcaagtcgaacgggatccgtgttacggaggtctttggaccgaagtggcatggtgagagtggcggacgggcgagtaacgcgtgagcaacctgccctatgctgggggataacaccgggaaaccggtgctaataccgcataagaccacagtgacgcatgtcacagtggtaaaagctgaggcggcataggatgggctcgcgtccgattagctagttggtagggtaacggcctaccaaggcgacgatcggtagccggactgagaggttggccggccgcattgggactgagacacggcccagactcctacgggaggcagcagtggggaatattgcgcaatgggggaaaccctgacgcagcgacgccgcgtggaggaagaaggcctttgggttgtaaactcctttgatcggggacgaagatgacggtacccgaagaacaagccacggctaactacgtgccagcagccgcggtaatacgtaggtggcgagcgttgtccggaattactgggtgtaaagggcgtgtaggcggggtgccaagtcaggtgtgaaataccggggcttaacctcgggggtgcatctgaaactggtgctcttgagtgccggagaggaaagcggaattcccagtgtagcggtgaaatgcgtagatattgggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccgtagttaacacaataagtatcccacctggggagtacggccgcaaggctgaaactcaaaggaattgacgggggcccgcacaagcagtggagcatgtggtttaattcgaagcaacgcgaagaaccttaccagggcttgacatccccctgacggatgtagagatacatcttctccgcaaggagcaggggagacaggtggtgcatggttgtcgtcagctcgtgtcgtgagatgttgggttaagtcccgcaacgagcgcaacccttgtcgttagttgccagcagtaagatgggcactctaacgagactgccggcgagaagtcggaggaaggtggggatgacgtcaaatcatcatgccccttatgtcctgggctacacacgtgctacaatggcgactacagagggaagcaaatccgcgaggaggagcaaatcccgaaaggtcgtcccagttcggattgcaggctgcaactcgcctgcatgaagccggaattgctagtaatggcaggtcagcatctgccgtgaatacgttcccgggctttgtacacaccgcccgtcacaccatgagagctggcaacacccgaagccggtagcctaaccgagaggggggcgccgtcgaaggtggggtcagtgattggggtgaagtcgtaacaaggtagccgtatcggaaggtgcggctggatcacctcctt

SEQ ID NO: 648 - DNA, 1437 bp, Clostridium sticklandii
  modified_base (47)..(49): a, c, t, g, unknown or other
  modified_base (71)..(71): a, c, t, g, unknown or other
  modified_base (90)..(90): a, c, t, g, unknown or other
  modified_base (169)..(169): a, c, t, g, unknown or other
  modified_base (309)..(309): a, c, t, g, unknown or other
  modified_base (339)..(339): a, c, t, g, unknown or other
  modified_base (346)..(346): a, c, t, g, unknown or other
  modified_base (361)..(361): a, c, t, g, unknown or other
  modified_base (426)..(426): a, c, t, g, unknown or other
  modified_base (457)..(457): a, c, t, g, unknown or other
  modified_base (480)..(480): a, c, t, g, unknown or other
  modified_base (494)..(494): a, c, t, g, unknown or other
  modified_base (511)..(511): a, c, t, g, unknown or other
  modified_base (520)..(520): a, c, t, g, unknown or other
  modified_base (568)..(569): a, c, t, g, unknown or other
  modified_base (808)..(808): a, c, t, g, unknown or other
  modified_base (811)..(811): a, c, t, g, unknown or other
  modified_base (857)..(857): a, c, t, g, unknown or other
  modified_base (1040)..(1040): a, c, t, g, unknown or other
  modified_base (1058)..(1058): a, c, t, g, unknown or other
  modified_base (1065)..(1065): a, c, t, g, unknown or other
  modified_base (1117)..(1117): a, c, t, g, unknown or other
  modified_base (1143)..(1144): a, c, t, g, unknown or other
  modified_base (1173)..(1173): a, c, t, g, unknown or other
  modified_base (1246)..(1246): a, c, t, g, unknown or other
  modified_base (1308)..(1308): a, c, t, g, unknown or other
  modified_base (1342)..(1342): a, c, t, g, unknown or other
tatttgagagtttgatcctggctcaggatgaacgctggcggcgtgcnnnacacatgcaagtcgaaaatgcnagcggcggacgggtgcgtnacacgtgggtaacctgcccctatcactgggataacacactgaaaagtgtgctaataccagataacataagcttttggcntcattagcttatcaaagaatttcggatagggatgggcccgcgtctgattagctagttggtgaggtaacggctcaccaaggcaacgatcagtagccgacctgagagggtgatcggccacactggaactgagacacggtccngactcctacgggaggcagcagtggggaatnttgcacnatgggcgaaagcctnatgcagcaacgccgcgtgagcgatgaaggccttcgggtcgtaaagctctgtcctatgggaagatnatgacggtaccataggaggaagccccggctnactacgtgccagcagccgcggtnatacgtagggggcnagcgttatccggaattnctgggcgtnaagggtgcgtaggcggtttatcaagtcaggggtgaaaggctacggctnnaccgtagtgagcctctgaaactggtgaacttgagtgtaggagaggaaagtggaattcccagtgtagcggtgaaatgcgtagatattgggaggaacaccagtggcgaaggcgactttctggactacaactgacgctgaggcacgaaagcgtggggagcaaacaggattagataccctggtagtccacgctgtaaacgatgagtactaggtgtcggctgtcaaaggtcggtgccggcgttnacncattaagtactccgcctggggagtacgctcgcaagagtgaaactcnaaggaattgacggggacccgcacaagtagcggagcatgtggtttaattcgaagcaacgcgaagaaccttacctaggcttgacatccctttgcaaagyccttaaccggrctcctyttsttcgsaaracaaaggtgacaggtggtgcatggttgtcgtcagctcgtgtcgtgagatgttgggttnagtcccgcaacgagcgcnacccctntttttagttgccatcagttaggctgggcactctagaaagactgccgaggacnactcggaggaaggtggggatgacgtnnaatcatcatgccccttatgcttagggctncacacgtgctacaatggctgttacaaagggctgcgagaccgcgaggtggagccaatcccagaaaaacagtctnagttcggattgtaggctgaaactcgcctacatgaagccggagttactagtaatcgcagatcngaatgctgcggtgaatgcgttcccgggtcttgtncacaccgcccgtcacaccatggaagttgggggcacccaaagttagttatccaaccttacgggggaggctacctaaggtgaattcaatgactgggg

SEQ ID NO: 649 - DNA, 1447 bp, Clostridium straminisolvens
  modified_base (56)..(56): a, c, t, g, unknown or other
gacgaacgctggcggcgtgcctaacacatgcaagtcgagcggagatatattgaagntttatcggatatatatcttagcggcggacgggtgagtaacgcgtgggtaacctgcctcatacagggggataacacagggaaacttgtgctaataccgcataacataacgaggcggcatcgctttgttatcaaaggagcaatccggtatgagatgggcccgcgtccgattagctagttggtgaggtaacggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgaaagtcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacaaagggaagctaagccgcgaggtggagcaaatccccaaaggcagccccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggaggacgctgccgaaggtggggccgatgattggggtga

SEQ ID NO: 650 - DNA, 1504 bp, Clostridium subterminale
agagggttgatcatggctcaggacgaacgctggcggcgtgcctaacacatgcaagtcgagcgatgaagcccttcggggtgaattagcggcggacgggtgagtaacacgtgggtaacctgccttatagagggggatagccttccgaaaggaagattaataccgcataatatgtttttatcgcatggtagaaacatcaaaggagcaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccagggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgaatacaaatagatgcaataccgcgaggtggagccaaactataaaattcatcccagttcggattgtagtctgaaactcgactacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggttggatcaccttcctta

SEQ ID NO: 651 - DNA, 1504 bp, Clostridium sulfidigenes
tgagtttgatcctggctcaggacgaacgctggcggcgtgcctaacacatgcaagtcgagcgatgaagcccttcggggtgaattagcggcggacgggtgagtaacacgtgggtaacctgccttatagagggggatagccttccgaaaggaagattaataccgcatgaaatgtttttatcgcatggtagaaacatcaaaggagtaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccacggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaaccggggaaagcttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgaatacaaatagatgcaataccgcgaggtggagccaaactataaaattcatcccagttcggattgtagtctgaaactcgactacatgaagccggagttgctagtaatcgcgaatcagcatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 652 - DNA, 1384 bp, Clostridium symbiosum
gaacgaagcgatttaacggaagttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagaaaggtggtgcatggagtgtcggagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagg

SEQ ID NO: 653 - DNA, 1378 bp, Clostridium tertium
gtcgagcgagaggagttccttcgggaacaaatctagcggcggacgggtgagtaacacgtgggcaacctgccttgtagaggggaatagccttccgaaaggaagattaataccgcataacattacattttcgcatgaagaagtaattaaaggagcaatccgctacaagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtcttcagggacgataatgacggtacctgaggaggaagccacggctaactacgtgccagcagccgcggtaatacgtaggtggcgagcgttgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattactcttaatcgaggaagtcccttcggggacaggatgacaggtggtgcatgggcgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaagggaggcagcga

SEQ ID NO: 654 - DNA, 1515 bp, Clostridium tetani
taaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagaggggaatagccctccgaaaggaggattaataccgcataaagttaaggtttcgcatgaaactttaaccaaaggagtaatctgctttgagatgggcccgcgccccattagctagttggtaaggtaatggcttaccaaggcgacgatgggtagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaaaccctgttttctgggacgataatgacggtaccagatgaggaagccacggctaactacgtgccagcagccgcggtaatacgtaggtggcaagcgttgtccggatttactgggcgtaaagggtgcgtaggcggatgcttaagtgagatgtgaaatacctaagcttaacttaggggctgcatttcaaactgggcatctagagtacaggagagggaaacggaattcctagtgtagcggtgaaatgcgtagagattaggaagaacaccagtggcgaaggcggtttcctggactgtaactgacgctgaggcacgaaagcgtgggtagcaaacaggattagataccctggtagtccacgccgtaaacgatgaatactaggtgtaggagggtccaaccttctgtgccgcagttaacacattaagtattccgcctggggagtacggtcgcaagactaaaactcaaaggaattgacgggggcccgcacaagcagcggagcatgtggtttaattcgaagcaacgcgaagaaccttacctagacttgacataccctgaattactcgtaactgaggaagtcccttcggggacagggatacaggtggtgcatggttgtcgtcagctcgtgtcgtgagatgttgggttaagtcccgcaacgagcgcaacccttattattagttgctaccattaagttgagcactctaatgagactgcctgggtgaaccaggaggaaggtggggatgacgtcaaatcatcatgccccttatgtctagggctacacacgtgctacaatggtcggtacagagagacgcaagaccgcgaggtggagcaaatctcaaaaaccgatcccagttcggattgcaggctgaaactcgcctgcatgaagccggagttgctagtaatcgcaaatcagaatgttgcggtgaatacgttcccgggccttgtacacaccgcccgtcacaccatgagagttggcaacacccgaagtccgtgaggtaaccgtaaggagccagcggccgaaggtggggttaatgattggggtgaagtcgtaacaaggtagccgtaggagaacctgcggctggatcacctcctttct

SEQ ID NO: 655 - DNA, 1521 bp, Clostridium thermocellum
agagtttgatcctggctcaggacgaacgctggcggcgtgcctaacacatgcaagtcgagcggggatatacggaaggtttaccggaagtatatcctagcggcggacgggtgagtaacgcgtgggtaacctacctcatacagggggataacacagggaaacctgtgctaataccgcataatataacggggcggcatcgtcctgttatcaaaggagaaatccggtatgagatgggcccgcgtccgattagctggttggtgaggtaacggctcaccaaggcgacgatcggtagccgaactgagaggttggtcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaaggaagtgacggtacccaaagaacaagccacggctaactacgtgccagcagccgcggtaatacgtaggtggcgagcgttgtccggaattactgggtgtaaagggcgcgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccctctgacagctctagagatagggcttcccttcggggcagaggagacaggtggtgcatggttgtcgtcagctcgtgtcgtgagatgttgggttaagtcccgcaacgagcgcaacccttgtcgttagttgccagcacgttaaggtgggcactctagcgagactgccggcgacaagtcggaggaaggtggggacgacgtcaaatcatcatgccccttatgtcctgggctacacacgtactacaatggctgctacaaagggaagcgataccgcgaggtggagcaaatccccaaaagcagtcccagttcggattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgtaaggagggcgctgccgaaggtggggcagatgattggggtgaagtcgtaacaaggtagccgtatcggaaggtgcggctggatcacctccttt

SEQ ID NO: 656 - DNA, 1360 bp, Clostridium tyrobutyricum
agcgatgaaaccccttcgggggtggattagcggcggacgggtgagtaacacgtgggtaacctgcctcaaagtgggggatagccttccgaaaggaagattaataccgcataaagccaagtttcacatggaatttggatgaaaggagtaattcgctttgagatggacccgcggcgcattagttagttggtggggtaatggcctaccaagacagcgatgcgtagccgacctgagagggtgatcggccacattggaactgagatacggtccagactcctacgggaggcagcagtggggaatattgcacaatgggcgaaagcctgatgcagcaacgccgcgtgagtgatgaaggtcttcggattgtaaagctctgtcttttgggacgataatgacggtaccaaaggaggaagccacggctaactacgtgccagcagccgcggtaatacgtaggtggcgagcgttgtccggatttactgggcgtaaagggtgcgtaggcggatgtttaagtgagatgtgaaatacccgggcttaacttgggtgctgcatttcaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaacgatgagtactaggtgtaggaggtatcgaccccttctgtgccgcagtaaacacattaagtactccgcctgggaagtacgatcgcaagattaaaactcaaaggaattgacgggggcccgcacaagcagcggagcatgtggtttaattcgaagcaacgcgaagaaccttacctggacttgacatcccctgaataacctagagataggcgaagcccttcggggcagggagacaggtggtgcatggttgtcgtcagctcgtgtcgtgagatgttaggttaagtcctgcaacgagcgcaacccttattgttagttgctaacattcagttgagcactctaacgagactgccgcggttaacgcggaggaaggtggggatgacgtcaaatcatcatgccccttatgtccagggcaacacacgtgctacaatgggcagaacaaagagaagcaataccgcgaggtggagccaaactcaaaaactgctctcagttcggattgcaggctgaaactcgcctgcatgaagctggagttgctagtaatcgcgaatcagcatgtcgcggtgaatacgttcccgggccttgtacacaccgcccgtcacaccatgagagctggcaacacccgaagtccgtagtctaacgtaagag

SEQ ID NO: 657 - DNA, 1482 bp, Clostridium viride
  modified_base (746)..(746): a, c, t, g, unknown or other
gatgaacgctggcggcgtgcttaacacatgcaagtcgaacggagccatctggaacaagttttcggacaagggaaagatgtgcttagtggcggacgggtgagtaacgcgtgagtaacctgccttggagtggggaataacacatcgaaaggtgtgctaataccgcatgatgcaacgggatcgcatggttctgttgccaaagatttatcgctctgagatggactcgcgtctgattagctagttggtgaggtaatggctcaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggccctcgggttgtaaacttcttttattcgagacgaaacaaatgacggtaccgaatgaataagccacggctaactacgtgccagcagccgcggtaatacgtaggtggcaagcgttatccggatttactgggtgtaaagggcgtgtaggcgggactgcaagtcagatgtgaaattccagggctcaactctggacctgcatttgaaactgtagttcttgagtgatggagaggcaggcggaattccgagtgtagcggtgaaatgcgtagatattcggaggaacaccagtggcgaaggcggcctgctggacattaactgacgctgaggcgcgaaagcgtggggagcanacaggattagataccctggtagtccacgctgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccctctgaccggtctagagataggccctccctcggggcagaggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtactacaatggcgcttaacagagggaggcaataccgcgaggtggagcaaacccctaaaaggcgtcccagttcggattgcaggctgaaacccgcctgtatgaagttggaatcgctagtaatcgcggatcagcatgccgcggtgaatacgttcccgggtcttgtacacaccgcccgtcacaccatgagagtcgggaacacccgaagtccgtagcctaacagcaatgagggcgcggccgaaggtgggttcgataattggggtgaagtcgtaacaaggtagccgtatcggaaggtgc

SEQ ID NO: 658 - DNA, 1441 bp, Clostridium xylanolyticum
  modified_base (830)..(830): a, c, t, g, unknown or other
  modified_base (1001)..(1001): a, c, t, g, unknown or other
  modified_base (1386)..(1386): a, c, t, g, unknown or other
gatcctggctcaggatgaacgctggcggcgtgcttaacacatgcaagtcgagcgaagcattttaaaggaagttttcggatggaatttagaatgacttagcggcggacgggtgagtaacgcgtgggtaacctgcctcatacagggggataacagttagaaatgactgctaataccgcataagcgcacagtgctgcatagtacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtnccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtctcgtaacggagacctnccttcggggcattccagacaggtggtgcatggttgtcgtcagctcgtgtcgtgagatgttgggttaagtcccgcaacgagcgcaacccttatccttagtagccagcatgtwatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacnccatgggagttggtaacgcccgaagtcagtgacccaaccgtaaggagggagctgc

SEQ ID NO: 659 - DNA, 1357 bp, Collinsella aerofaciens
  modified_base (766)..(766): a, c, t, g, unknown or other
acggcacccctctccggagggaagcgagtggcgaacggctgagtaacacgtggagaacctgccccctcccccgggatagccgcccgaaaggacgggtaataccggatacccccgggcgccgcatggcgcccgggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctgggtgtggggggacgatccccccgtgccgcagccnacgcattaagcgtcccgcctggggagtacggccgcaaggctaaaactcaaaggaattgacgggggcccgcacaagcagcggagcatgtggcttaattcgaagcaacgcgaagaaccttacggcgcatccccccgaggcccacggggggtccgccgcgtgggtcagaggagcgcatacgggaggtgcatggttgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggg

SEQ ID NO: 660 - DNA, 1340 bp, Collinsella intestinalis
gaacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcaggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggataacggcggcgaaggccgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccg

SEQ ID NO: 661 - DNA, 1264 bp, Collinsella stercoris
  modified_base (1223)..(1224): a, c, t, g, unknown or other
gccccctcctccgggatagcctcgggaaaccgtgggtaataccggatgaccccggcaggccgcatggccggccgggcaaagcccagacgggaggggatggctccgcggcccatcaggtagacggcggggtgacggcccaccgtgccgacgacgggtagccgggttgagagaccgaccggccagattgggactgagacacggcccacactcctacgggaggcagcagtggggaatcttgcgcaatggggggaaccctgacgcagcgacgccgcgtgcgggacgaaggccctcgggtcgtaaaccgctttcagcggaacaaacgtgcagaagaagccccggctaactacgtgccagcagccgcggtatacgtagggggcgagcgttatccggattcattgggcgtaaagcgcgcgtagcggcccggcaggcagggggtcaaatggcggggctcaaccccgtcccgccccctgaaccgccgggctcggtccggtaggggagggtggaacacccggtgtacggtggaatgcgcagatatcgggtggaacaccggtggcgaagcggcctctgggccgaaccgacgctgagcgcgaaagctgggggagcgaacaggattaaataccctggtagtcccagccgtaaacgatggacgctaggtgtgggaggggaacccttccgtgccgcagcccacgcattaggcgtcccgcctggggagtacggccgcaaggctaaaactccaaggaattgactgggggccctcaaagcagcggagcatgtggcttaattcgaagcaacgcgaagaaccttaccagggcttgacatgcgcgtgaagccggggagacccggtggccgagaggagcgcgcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccnncacaccacccgagtcgtctgcacccgaagtcgccggccca

SEQ ID NO: 662 - DNA, 1356 bp, Collinsella tanakaei
tcatggctcaggatgaacgctggcggcgcgcctaacacatgcaagtcgaacgagtggcgaacggctgagtaacacgtggagaacctgccccctcctcggggatagccgcgggaaaccgcgggtaacacccgacgaccaaatgagggaggggatggctccgcggcccatcaggtagacggcggggtaacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgaccgacgctgaggcgcgaaagctgggggagcgaacaggattagataccctggtagtcccagccgtaaacgatggacgctaggtgtgggggcctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgcacaggtggtgcatggctgtcgtcagctcgtgtcgtgagatgttgggttaagtcccgcaacgagcgcaacccccgccgcatgttgccagcagctgggcacccatgcgggaccgccggcgtcaagccggaggagggcggggacgacgtcaagtcatcatgccccttatgccctgggctgcacacgtgctacaatggccggcagcgggatgcgatggcgcgagccggagcggatccctcccggccccagttcggatgggggctgcaacccgcccccagaagtcggagttgctagtaatcgcggatcagcatgccgcggtgaatgcgttcccgggccttgtacacaccgcccgtcacaccacccgagtcgtctgcacccgaagccgccgcccagggaggcgtcgaaggtgtggagggtgaggggggtgaagtcgtaacaaggtagccgtacgggaacgtgcggctggatcacctcct

SEQ ID NO: 663 - DNA, 1505 bp, Comamonadaceae bacterium NML000135
attgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtgcagaacgaaaaatctctggttaatacctggggatcatgacggtactgcaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcatttagttgggcactctaatgagactgccggtgataaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaaggtgcggctggatcacc

SEQ ID NO: 664 - DNA, 1450 bp, Comamonadaceae bacterium NML790751
tacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggaacatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcatttagttgggcactctaatgagactgccggtgataaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagtcttaaccgtaaggagggcgcttaccacggcagggctcgtgactggggtgaagtcgtaaca

SEQ ID NO: 665 - DNA, 1485 bp, Comamonadaceae bacterium NML910035
aacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcattaagttgggcactctaatgagactgccggtgataaaccggaggaaggtggggatgacgtcaagtcctcatggcccttataggtggggctacacacgtcatacaatggccggtacaaagggcaggcaacccgcgagggggagcaaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaag

SEQ ID NO: 666 - DNA, 1480 bp, Comamonadaceae bacterium NML910036
attgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacggccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcattaagttgggcactctaatgagactgccggtgataaaccggaggaaggtggggatgacgtcaagtcctcatggcccttataggtggggctacacacgtcatacaatggccggtacaaagggcagccaacccgcgagggggagcaaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccg

SEQ ID NO: 667 - DNA, 1499 bp, Comamonadaceae bacterium oral taxon F47
agagtttgatcctggctcagattgaacgctggcggcatgctttacacatgcaagtcgaacggcagcggagaggtgcttgcacttctgccggcgagtggcgaacgggtgagtaatgtatcggaacgtgcccagtagtgggggataactactcgaaagagtggctaataccgcatgagatctctggatgaaagcgggggaccgtaaggcctcgcgctactggagcggccgatatcagattaggtagttggtggggtaaaggcctaccaagcctgcgatctgtagctggtttgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagctcttctctaatacaggggggtaatgacggtactgtaagaataagcgccggctaactacgtgccagcagccgcggtaatacgtagggtgcgagcgttaatcggaattactgggcgtaaagcgtgcgcaggcggttttgtaagacagaggtgaaatccccgggcttaacctgggaactgcctttgtgactgcaaggcttgagtgcggcagagggggatggaattccgcgtgtagcagtgaaatgcgtagatatgcggaggaacaccgatggcgaaggcagtcccctgggcctgcactgacgctcatgcacgaaagcgtggggagcaaacaggattagataccctggtagtccacgccctaaacgatgtcaactggttgttggaatttattttttcagtaacgttgctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgcaagagagcctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacaaagggtagccaacccgcgagggggagccaatcccgcaaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtggttagcctaaccgcaaggagggcgatcaccacggcagggttcgtgactggggtgaagtcgtaacaaggtagccgt

SEQ ID NO: 668 - DNA, 1521 bp, Comamonas sp. NSP5
agagtttgatcctggctcagattgaacgctggcggcatgctttacacatgcaagtcgaacggtaacaggccgcaaggtgctgacgagtggcgaacgggtgagtaacacatcggaacgtgcccagttgtgggggataactactcgaaagagtagctaataccgcatgagaacttaggttgaaagcaggggaccgcaagaccttgcgcaaacagagcggccgatggcagattaggtagttggtgggataaaggcttaccaagccgacgatctgtagctggtctgagaggacgaccagccacactgggactgagacacggcccagactcctacgggaggcagcagtggggaatttgggacaatgggcgcaagcctgatccagcaatgccgcgtgcaggatgaaggccttcgggttgtaaactgctttggtacggaacgaaaaagctctggttaatacctggggcccatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtattcactttctcagtaacgaagctaacgcgtgaagttgaccccctggggagtacggccccaaggttaaaactcaaaggaattgacggggacccgcacaagcggtggatgatgtggtttaattcgatgcaacgcgaaaaaccttacccacctttgacatgtacggaaccctttagagatagaggggtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacaaagggtagccaacccgcgaggtggagctaatcccataaagccggtcgtagtccggatcgcagtctgcaactcgactgcgtgaagtcggaatcgctagtaatcgtggatcagaatgtcacggtgaatacgttcccgggtcttgtacacaccgaccgtcacaccatgggagcgggttctgccagaagtaggtagcctaaccgtaaggagggcgcttaccacggcggggttcgtgactggggtgaagtcgtaacaaggtagccgtatcggaaggtgcggctggatcacctcctt

SEQ ID NO: 669 - DNA, 1464 bp, Conchiformibius kuhniae
attgaacgctggcggcatgctttacacatgcaagtcggacggcagcrsggaggagcttgcttctykgsyggcgagtggcgaacgggtgagtaacgcattggaacgtaccggatagagggggataacttgccgaaaggtaagctaataccgcatacgccttgagagggaaagcgggggactctttgagcctcgcgctatccgagcggccaatgtctgattagctagttggtggggtaaaagcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtacgggaagaaaagggtggtgctaatatcgctgcctcatgacggtaccgtaagaataagcaccggctaactacgtgccagcagccgcggtaatacgtagggtgcgagcgttaatcggaattactgggcgtaaagcgggcgcagacggttacttaagcaagatgtgaaatccccgagcttaacttgggaactgcgttttgaactgggtagctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttggggtacttgataccttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaagagcttagagataggcttgtgccttcgggaaccgtaacacaggtgctgcatggctgtcgtcagctcgtgtcgtgagatgttgggttaagtcccgcaacgagcgcaacccttgtcatcagttgccatcattaagttgggcactctgatgagactgccggtgacaaaccggaggaaggtggggatgacgtcaagtcctcatggcccttatgaccagggcttcacacgtcatacaatggtcggtacaaagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaattgggtagggtaaccatttggagcccgcttaacacggtatgcttcatgactggggtg

SEQ ID NO: 670 - DNA, 1486 bp, Coprobacillus cateniformis
agagtttgatcctggctcaggatgaacgctggcggcgtgcctaatacatgcaagtcgaacgcactgattttatcagtgagtggcgaacgggtgagtaatacataagtaacctgccctcatgagggggataactattagaaatgatagctaagaccgcataggtgaaggggtcgcatgaccgcttcattaaatacccgtatggatagcaggaggatggacttatggcgcattagctggttggtgaggtaacggctcaccaaggcgacgatgcgtagccgacctgagagggtggacggccacactgggactgagacacggcccagactctacgggaggcagcagtagggaattttcggcaatgggggaaaccctgaccgagcaacgccccgtgaggcaagaagtatttcggtatgtaaacctctgttataaaggaagaacggtatgaataggaaatgattcataagtgacggtactttatgagaaagccacggctaactacgtgccagcagccgcggtaatacgtaggtggcgaccgttatccggaatcattggccgtaaagagggagcaggcggcaatagaggtctgcggtgaaagcctgaagctaaacttcagtaagccgtggaaaccaaatagctagagtgcagtagaggatcgtggaattccatgtgtagcggtgaaatgcgtagatatatggaggaacaccagtggcgaaggcgacgatctgggctgcaactgacgctcagtcccgaaaccgtggggagcaaataggattagataccctagtagtccaacgccgtaaacgatgagtactaagtgttgggggtcaaacctcagtgctgcagttaacgcaataagtactacgcctgagtagtacgttcgcaagaatgaaactcaaaggaattgacgggggcccgcacaaaaggtggagcatgtggtttaattcgaagcaacgcgaagaaccttaccaggtcttgacatacctctaaaggctctagagatagagagatagctataggggatacaggtggtgcatggttgtcgtcagctcgtgtcgtgagatgttgggttaagtcccgcaacgagcgcaacccttgtcgctagttaccatcattaagttggggactctagcgagactgcctctgcaaggaggaggaaggcggggatgacgtcaaatcatcatgccccttatgacctgggctacacacgtgctacaatggacggatcaaagggaagcgaagccgcgaggtggagcgaaacccaaaaacccgttctcagttcggactgcagtctgcaactcgactgcacgaagttggaatcgctagtaatcgcgaatcagaatgtcgcggtgaatacgttctcgggccttgtacacaccgcccgtcacaccatgagagttggtaacacccgaagccggtggcttaaccgcaaggagagagctgtctaaggtgggactgatgattagggtgaagtcgtaacaaggtaacc

SEQ ID NO: 671 - DNA, 977 bp, Coprobacillus sp. 29_1
  modified_base (30)..(30): a, c, t, g, unknown or other
attcataagtgacggtactttatgagaaanccacggctaactacgtgccagcagccgcggtaatacgtaggtggcgagcgttatccggaatcattgggcgtaaagagggagcaggcggcaatagaggtctgcggtgaaagcctgaagctaaacttcagtaagccgtggaaaccaaatagctagagtgcagtagaggatcgtggaattccatgtgtagcggtgaaatgcgtagatatatggaggaacaccagtggcgaaggcgacgatctgggctgcaactgacgctcagtcccgaaagcgtggggagcaaataggattagataccctagtagtccacgccgtaaacgatgagtactaagtgttgggggtcaaacctcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatacctctaaaggctctagagatagagagatagctataggggatacaggtggtgcatggttgtcgtcagctcgtgtcgtgagatgttgggttaagtcccgcaacgagcgcaacccttgtcgctagttaccatcattaagttggggactctagcgagactgcctctgcaaggaggaggaaggcggggatgacgtcaaatcatcatgccccttatgacctgggctacacacgtgctacaatggacggatcaaagggaagcgaagccgcgaggtggagcgaaacccaaaaacccgttctcagttcggactgcagtctgcaactcgactgcacgaagttggaatcgctagtaatcgcgaatcagaatgtcgcggtgaatacgttctcgggccttgtacacaccgcccgtcacaccatgagagttggtaacacccgaagccggtggcttaaccgcaaggag

SEQ ID NO: 672 - DNA, 1383 bp, Coprobacillus sp. D7
  modified_base (7)..(8): a, c, t, g, unknown or other
cagtcgnncgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgaggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaa

SEQ ID NO: 673 - DNA, 989 bp, Coprococcus catus
  modified_base (743)..(743): a, c, t, g, unknown or other
  modified_base (947)..(947): a, c, t, g, unknown or other
  modified_base (965)..(965): a, c, t, g, unknown or other
gatgaagagcttgcttttcaaagttagtggcggacgggtgagtaacgcgtgggtaacctgcctcatacaggggaatagcagctggaaacggctgataaaaccgcataagcgcacagtgccgcatggcacagtgtgaaaaactccggtggtatgagatggacccgcgtctgattagcttgttggcggggtaacggcccaccaaggcgacgatcagtagccggcctgagagggtgatcggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtaggcggcggagcaagtcagaagtgaaagcccggggctcaaccccgggacggcttttgaaactgccctgcttgatttcaggagaggtaagcggaattcctagtgtagcggtgaaatgcgtagatattaggaggaacaccagtggcgaaggcggcttactggactgacaatgacgctgaggctcgaaagcgtggggagcaaacaggattagataccctggtagtccacgccgtaaacgatgaatactaggtgtcggggcntcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggccttgacatcccggtgaccgacccgtaatggggtcttctctacggagcactggngacaggtggtgcatggtngtcgtcagctcgtgtcgtgagatg

SEQ ID NO: 674 - DNA, 1370 bp, Coprococcus comes
gattcttcggatgaagaggtttgtgactgagtggcggacgggtgagtaacgcgtgggtaacctgcctcatacagggggataacagttagaaatgactgctaataccgcataagaccacggagccgcatggctccgtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcaggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctg

SEQ ID NO: 675 - DNA, 1440 bp, Coprococcus eutactus
gatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacrgtatcgcatgatacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaagggactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttctcttcggagcatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcraacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtg

SEQ ID NO: 676 - DNA, 1440 bp, Coprococcus sp. ART55/1
gatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtrtcgcatgayacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaaggaactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtg

SEQ ID NO: 677 - DNA, 1370 bp, Coriobacteriaceae bacterium BV3Ac1
acatgcaagtcgaacgattaaagcaccttcgggtgtgtatagagtggcgaacggctgagtaacacgtgggcaacctgcccttcagttcggaatagctacgggaaaccgtgggtaataccggatgatccacctccctcgcatgaaggaggtggcaaagatttatcgctgaaggatgggcccgcggcctgttagcttgttggtgaggtaacggctcaccaaggcagtaatgggtagccgggttgagagaccgaccggccagattgggactgagacacggcccagactcctacgggaggcagcagtggggaatcttgcgcaatgggcgaaagcctgacgcagcgatgccgcgtgcgggatgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcaagagttaaatccgggggctcaacccccgtccgctcctgataccggcaggcttgagtctggtaggggaaggcggaattccaagtgtagcggtggaatgcgcagatatttggaagaacaccggtggcgaaggcggccttctgggccacgactgacgctgaggcgcgaaagctaggggagcaaacaggattagataccctggtagtcctagccgtaaacgatggacactaggtgtggggggaacatccctccgtgccgcagctaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatataggtgaagcggtggaaacaccgtagccgaaaggagcctatacaggtggtgcatggctgtcgtcagctcgtgtcgtgagatgttgggttaagtcccgcaacgagcgcaacccccgtcgtatgttgccagcggttcggccgggcacccatacgagaccgccggcgtcaagccggaggaaggtggggacgacgtcaagtcatcatgccccttatgtcctgggctgcacacgtgctacaatggccggcacaatgggctgccaagtcgcaagaccgagcgaatccctaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaacctt

SEQ ID NO: 678 - DNA, 1491 bp, Coriobacteriaceae bacterium JC110
agagtttgatcctggctcaggatgaacgctggcggcgtgcctaacacatgcaagtcgaacgatgaaaccgcccccgggcggacatgaagtggcgaacgggtgagtaacacgtgaccgacctgccccccgcccagggacagccccccgaaagggggattaatacctggtactccgggagcggcgcatgccgcccccgggaaagctctcgcggcgggggatggggtcgcggcccatcaggtagacggcggggcagaggcccaccgtgccgacgacgggtagccgggttgagagaccgaccggccacattgggactgagatacggcccagactcctacgggaggcagcagtggggaattttgcgcaatgggggcaaccctgacgcagcaacgccgcgtgcgggacgaaggcgtccgcgtcgtaaaccgctttcagcggggaacacctaacgagggtacccgcagaagaagccccggctaaatacgtgccagcagccgcggtaatacgtatggggcgagcgttatccggattcattgggcgtaaagcgcgcgtaggcggagcgctaagcgggacctctaacccgagggctcaacccccggccgggtcccgaactggcgctctcgagtgcggtaggggagagcggaattcccggtgtagcggtggaatgcgcagatatcgggaagaacaccgacggcgaaggcagctctctgggccgaaactgacgctgaggcgcgaaagctgggggagcgaacaggattagataccctggtagtcccagccgtaaacgatgggcgctaggtgtgggggatgagatcccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggagacgccgtggccgagaggagcctgcacaggtggtgcatggctgtcgtcagctcgtgtcgtgagatgttgggttaagtcccgcaacgagcgcaacccctgccccgtgttgccagcattcagttggggactcgcgggggactgccggcgtcaagccggaggaaggtggggacgacgtcaagtcatcatgccccttatgccctgggccgcacacgtgctacaatggccggtacagagggttgcgaccccgcgagggggagcggatcccgcaaagccggccccagttcggatcggaggctgcaacccgcctccgtgaagccggagttgctagtaatcgcggatcagcacgccgcggtgaatacgttcccgggccttgtacacaccgcccgtcacaccacccgagtcgtctgcacccgaagccgccggccgaaccctttcaggggcggaggcgtcgaaggtgtggagggtgaggggggtgaagtcgtaacaaggtagccgtaccggaaggtgcggctg

SEQ ID NO: 679 - DNA, 1464 bp, Coriobacteriaceae bacterium phI
gatcctggctcaggatgaacgctggcggcgcgcctaacacatgcaagtcgagcggcaccctgcttcggcaggaagcgagcggcgaacggctgagtaacacgtgaccaacctgccctgcgcacggggacagccgcgggaaaccgcgggtgatacccggtggccccggggggacgcatgtccccagcgggcatagctccggcggcgcgggatggggtcgcggcccatcaggtagttggtagggtgacggcctaccaagccgactacgggtagccgggttgagagaccgaccggccagattgggactgagacacggcccagactcctacgggaggcagcagtggggaatcttgcgcaatggggggaaccctgacgcagcgacgccgcgtgcgggatggaggccttcgggtcgtgaaccgctttcagcagggacgagactgacggtacctgcagaagaagccccggctaactacgtgccagcagccgcggtaatacgtagggggcgagcgttatccggattcattgggcgtaaagcgcgcgtaggcggccgcgcaggcggggggtcaaatcccggggctcaaccccgggccgccccccgaaccgcgcggcttgggtccggcaggggagggtggaacgcccggtgtagcggtggaatgcgcagatatcgggcggaacaccggtggcgaaggcggccctctgggccggcaccgacgctgaggcgcgagagccgggggagcgaacaggattagataccctggtagtcccggccgtaaacgatggacgctaggtgtggggacgttggagtctccgtgtgccgcagccaacgcattaagcgtcccgcctggggagtacggccgcaaggctaaaactcaaaggaattgacgggggcccgcacaagcagcggagcatgtggcttaattcgaagcaacgcgaagaaccttacccgcgcttgacatggcggtgaagcggcggagacgccgtggccgagaggagccgccacaggtggtgcatggctgtcgtcagctcgtgtcgtgagatgttgggttaagtcccgcaacgagcgcaacccccgccgcgtgttgccatcgggtgatgccgggaacccacgcgggaccgccgccgccaaggcggaggagggcggggacgacgtcaagtcatcatgccccttatgcgcggggctgcacacgtgctacaatggcaggtacagagggttgccaccccgcgagggggagcggatcccgaaagcctgccccagttcggaccgggggctgcaacccgcccccgcgaagtcggagttgctagtaatcgcggatcagcatgccgcggtgaatgcgttcccgggccttgtacacaccgcccgtcacaccacccgagtcgtctgcacccgaagccgccggcccaacctcgtgagggaggcgtcgaaggtgtggagggcgaggggggtgaagtcgtaacaaggtagccgta

SEQ ID NO: 680 - DNA, 1497 bp, Gordonibacter pamelaeae
agagtttgatcctggctcaggatgaacgctggcggcgtgcctaacacatgcaagtcgaacgattaagacggctccggccgtgaatagagtggcgaacgggtgagtaacacgtgaccaacctgccccctaccccgggataacgcaaggaaacctgcgctaataccggatactccttcccctgctcctgcaggggtcgggaaagcccagacggtaggggatggggtcgcggcccattaggtagacggcggggcaacggcccaccgtgcctgcgatgggtagccgggttgagagaccgaccggccacattgggactgagatacggcccagactcctacgggaggcagcagtggggaattttgcgcaatggggggaaccctgacgcagcaacgccgcgtgcgggatgaaggccttcgggttgtaaaccgctttcagcagggaagatagtgacggtacctgcagaagaagccccggctaactacgtgccagcagccgcggtaatacgtagggggcgagcgttatccggattcattgggcgtaaagcgcgcgtaggcggcccgtcaagcggaacctctaacccgagggctcaacccccggtcgggttccgaactggcaggctcgagtttggtagaggaagatggaattcccggtgtagcggtggaatgcgcagatatcgggaagaacaccgatggcgaaggcagtcttctgggccatcaactgacgctgaggcgcgaaagctgggggagcgaacaggattagataccctggtagtcccagccgtaaacgatgggtgctaggtgtggggggatcatccctccgtgccgcagccaacgcattaagcaccccgcctggggagtacggccgcaaggctaaaactcaaaggaattgacgggggcccgcacaagcagcggagcatgtggcttaattcgaagcaacgcgaagaaccttaccagggcttgacatgctagtgaagccggggaaacccggtggccgagaggagctagcgcaggtggtgcatggctgtcgtcagctcgtgtcgtgagatgttgggttaagtcccgcaacgagcgcaacccctatcgtatgttgccagcattgagttggggactcatacgagactgccggcgtcaagccggaggaaggtggggacgacgtcaagtcatcatgccctttatgccctgggctgcacacgtgctacaatggccggtacaacgggccgcgacctggcgacaggaagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacct

SEQ ID NO: 681 - DNA, 1522 bp, Corynebacterium accolens
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcttgggaaactgggtctaataccggataggaaccatctttagtgtggtggttggaaagttttttcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcataacttgagtgctgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtctttctacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttccctttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgctgcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcctaaacgtgttagggagccgtcgaaggtgggatcggcgattgggacgaagtcgtaacaaggtacccgtaccggaaggtgcgggtggatcacctcctttct

SEQ ID NO: 682 - DNA, 1530 bp, Corynebacterium ammoniagenes
tttttgtggagagtttgatcctggctcaggatgaacgctggcggcgtgcttaacacatgcaagtcgaacggaaaggcctgtacttgtacaggtactcgagtggcgaacgggtgagtaacacgtgggtgatctgccctgcactatgggataagcttgggaaactgggtctaataccatataggaccacttcttggatgttgtggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgacggccttcgggttgtaaactcctttcgctatcgacgaagccaccttgggtggtgacggtaggtagataagaagcaccggctaactacgtgccagcagccgcggtaatacgtagggtgcaagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggattgggctagagatagttcgtcccttgtggtctgtatacaggtggtgcatggttgtcgtcagctcgtgtcgtgagatgttgggttaagtcccgcaacgagcgcaacccttgtcttatgttgccagcacgtgatggtggggactcatgagaaactgccggggttaactcggaggaaggtggggatgacgtcaaatcatcatgccccttatgtccagggcttcacacatgctacaatggtcgatacaatgggcagcgacatcgtgaggtggagcgaatccctgaaagtcggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcggctggatcacctcctttct

SEQ ID NO: 683 - DNA, 1529 bp, Corynebacterium amycolatum
ttttgatggagggtttgatcctggctcaggacgaacgctggcggcgtgcttaacacatgcaagtcgaacggtaaggctccagcttgctggggtacacgagtggcgaacgggtgagtaacacgtgggtgacctgccctgcacttcgggataagcctgggaaactgggtctaataccggataggaccatggtgtggatactgtggtggaaagttttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcgcaagcctgatgcagcgacgccgcgtgggggatgacggccttcgggttgtaaactcctttcaccatcgacgaagggtttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatggggagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgcgccagagatggtgtttcccttgtggcttgtatacaggtggtgcatggttgtcgtcagctcgtgtcgtgagatgttgggttaagtcccgcaacgagcgcaacccttgtcttatgttgccagcacgtgatggtggggactcgtaagagactgccggggttaactcggaggaaggtggggatgacgtcaaatcatcatgccccttatgtccagggcttcacacatgctacaatggtcggtacagtgggttgccagtccgtgagggcgagctaatcccgtaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacacttttttgtgggggagctgtcgaaggtgggattggcgattgggacgaagtcgtaacaaggtagccgtaccggaaggtgcggctggatcacctcctttct

SEQ ID NO: 684 - DNA, 1469 bp, Corynebacterium appendicis
cgtgcttaacacatgcaagtcggaacggaaaggcctctgcttgcaggggtactcgagtggcgaacgggtgagtaacacgtgggtgatctgccctgcacttcgggataagcctgggaaactgggtctaataccggataggacgatggtttggatgccattgtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgtcagggacgaagcgaaagtgacggtacctggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgatactgtgaggtggagctaatcgcctaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagcggcccaaacgtgttagggagctgtcgaaggtgggatcggcgattgggacgaagtcgtaacaaggtagccgtaccggaaggtgcggctggatcac

SEQ ID NO: 685 - DNA, 1420 bp, Corynebacterium argentoratense
  modified_base (776)..(776): a, c, t, g, unknown or other
  modified_base (1061)..(1061): a, c, t, g, unknown or other
  modified_base (1365)..(1365): a, c, t, g, unknown or other
cgaacggaaaggcctaagacttgcttgggtactcgagtggcgaacgggcccattaacacgtgagtgatctgccctcaacttcgggataagcctgggaaactgggtctaatactggataggaccatcctttagtgtgtgatggtggaaagttttttcggttggggatgagctcgcggcctatcagcttgttggtggggtaatggcctaccaaggcgtcgacgggtagccggcctgacagggtgtacggccacattgggactgagacacggcccagactcctacaggaggcagcagtggggaatattgcacaatgggcggaagcctgatgcagcgacgccgcgtgagggatgacggccttcgggttgtaaacctctttcgacagggacgaagcttttgtgacggtgacctgtataagaaagcaccggctaactacgtgccaagcagccgcggtaatacgttacgggtgcgagcgttgtccggaattactgggcgtaaagagctcgtagcgtggtttgtcgcgtcgtctgtgaaattccggggcttaactccgggcgtgcaggcgatacgggcataacttgagtgctgtaggggagactggaattcctggtgtaacggtgaaatgcgcatatatcaggaggaacaccgatggcgaaagcaggtctctgggcagtaactgacgctgaggagcgaaagcatggggagcgaacaggattagataccctggtagttcatgccgtaaacggtgggcgctaggtgtaggggacttccacgtcttntgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgctgcagagatgtagtttcccttgtggtctgtatacaggtggtgcatggttgtcgtcagctcgtgtcgtgagatgttgggttaagtcccgcaacgagcgcaacccttgtcttatgttgccagcacactntggtggggactcatgagagactgccggggttaactcggaggaaggtggggatgacgtcaaatcatcatgccccttatgtccagggcttcacacatgctacaatggtcggtacaacgcgctgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcaagtcaccgaaagttggtaacacccgaaaaccngtggcctaacccttgtggagggagctgtcgaaggtgggattcggcgattggtcta

SEQ ID NO: 686 - DNA, 1482 bp, Corynebacterium atypicum
gacgaacgctggcggcgtgcttaacacatgcaagtcgtacggaaaggccctgcttttgtggggtgctcgagtggcgaacgggtgagtaacacgtgggtgatctgccctgtacttcgggataagcttgggaaactgggtctaataccggataggactgcgctgtgggtggtgtggtggaaagctttttgcggtatgggatgagctcgcggcctatcagtttgttggtggggtaatggcctaccaaggcgtcgacgggtagccggcctgagagggtgatcggccacattgggactgagatacggcccagactcctgcgggaggcagcagtggggaatattgcacaatgggcgcaagcctgatgcagcgacgccgcgtgggggatgacggccttcgggttgtaaacctctttcgactatgacgaagcctttttggtgacggtagtggtagaagaagcaccggctaactacgtgccagcagccgcggtaatacgtagggtgcgagcgttgtccggatttactgggcgtaaagggctcgtaggtggtttgtcgcgtcgtctgtgaaattccggggcttaacttcgggcgtgcaggcgatacgggcataacttgagtgctgtaggggtaactggaattcctggtgtagcggtggaatgcgcagatatcaggaggaacaccgatggcgaaggcaggttactgggcagttactgacgctgaggagcgaaagcatggggagcgaacaggattagataccctggtagtccatgctgtcaacggtgggcgctaggtgtggggatcttccacggtccctgtgccgtagctaacgttttaagcgccccgcctggggagtacggccgcaaggctaaaactcaaaggaattgacgggggcccgcacaagcggcggagcatgtggattaattcgatgcaacgcgaagaaccttacctgggtttgatatacatcagatcgggccagagatggtctttccctttgtggttggtgtacaggtggtgcatggttgtcgtcagctcgtgtcgtgagatgttgggttaagtcccgcaacgagcgcaacccttgtcttgtgttgccagcatttggttggggactcacgagagactgccggggtgaactcggaggaaggtggggatgacgtcaaatcatcatgccccttatgtccagggcttcacacatgctacaatggtcggtacagtaggttgcgataccgtgaggtggagctaatcctcgtgaaagccggtcgtagttcggattgaggtctgcaactcgacctcatgaagtcggagtcgctagtaatcgcagatcagcagtgctgcggtgaatacgttcccgggccttgtacacaccgcccgtcacgtcatgaaagtcggtaacacccgaagcccacggcctaaccttgttgtaaggggggagtggtcgaaggtgggatcggcgattgggacgaagtcgtaacaaggtagccgtaccggaagg

SEQ ID NO: 687 - DNA, 1522 bp, Corynebacterium aurimucosum
tttttgtggagagtttgatcctggctcaggacgaacgctggcggcgtgcttaacacatgcaagtcgaacggaaaggcctcagcttgctggggtactcgagtggcgaacgggtgagtaacacgtgggtgatctgccttgcactctgggataagcttgggaaactgggtctaataccggatatgaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagcgttatgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagattgctgcagagatgtagtgtcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttct

SEQ ID NO: 688 - DNA, 1327 bp, Corynebacterium bovis
gacgaacgctggcggcgtgcttaacacatgcaagtcgaacgagtggcgaacgggtgagtaacacgtgggtgatctgccctgcactctgggataagcctgggaaactgggtctaataccggatagggaaagcggtgcaggatgagcccgcggcctatcagcttgttggtggggtaatggcctaccaaggcggcgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaacccctttcggcagggacgatgacggtacctgcataagaagcaccggctaactacgtgccagcagccgcggtaatacgtagggtgcgagcgttgtccggaattactgggcgtaaagagctcgtaggtggtttgtcgcgtcgtctgtgaaatcccggggcttaactccgggcgtgcaggcgatacgggcaaacttgagtgctgtaggggagactggaattcctggtgtagcggtgaaatgcgcagatatcaggaggaacaccgatggcgaaggcaggtctctgggcagactgacgctgaggagcgaaagcatgggtagcgaacaggattagataccctggtagtccatgccgtaaacggtgggcgctaggtgtggggatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcacaggtggtgcatggttgtcgtcagctcgtgtcgtgagatgttgggttaagtcccgcaacgagcgcaacccttgtcttgtgttgccagcacgtggggactcgcgagagactgccggggttaactcggaggaaggtggggatgacgtcaaatcatcatgccccttatgtccagggcttcacacatgctacaatggtcggcagtgggttgcgatgccgcgaggctcagctaatcccttccggtctcagttcggatggagtctgcaactcgactccagaagtcggagtcgctagtaatcgcagatcagcaacgctgcggtgaatacgttcccgggccttgtacacaccgcccgtcacgtcatgaaagttggtaacacccgaagccggtgcccagggagccgtcgaaggtgggatcggcgattgggacgaagtcgtaacaaggtagccgtaccggaagg

SEQ ID NO: 689 - DNA, 1497 bp, Corynebacterium canis
gacgaacgctggcggcgtgcttaacacatgcaagtcgtacggaaaggccctggctttggttggggtgctcgagtggcgaacgggtgagtaacacgtgggtgatctgccctgcactttgggataagcctgggaaactgggtctaatactggataggaccatgcttttgtgtgtcatggtggaaaggcttctgttttgggggctggtgtgggatgagcttgcggcctatcagcttgttggtggggtaatggcctaccaaggcgtcgacgggtagccggcctgagagggtgtacggccacattgggactgagatacggcccagactcctgcgggaggcagcagtggggaatattgcacaatgggcgcaagcctgatgcagcgacgccgcgtgagggatgacggccttcgggttgtaaacctctttcgctggggacgaagcttttttggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtcttccacgacttctgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgcgccagagatggtgtttcccttgtggcttgtatacaggtggtgcatggttgtcgtcagctcgtgtcgtgagatgttgggttaagtcccgcaacgagcgcaacccttgtcttatgttgccagcacgtgatggtggggactcatgagagactgccggggtcaactcggaggaaggtggggatgacgtcaaatcatcatgccccttatgtccagggcttcacacatgctacaatggtcggtacagtgggttgcgagaccgtgaggtggagcgaatccctttgaaagccggcctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccagcgtttgctggggggagtggtcgaaggtgggattggcgattgggacgaagtcgtaacaaggtagccgtaccggaagg

SEQ ID NO: 690 - DNA, 1343 bp, Corynebacterium casei
  modified_base (364)..(364): a, c, t, g, unknown or other
  modified_base (369)..(369): a, c, t, g, unknown or other
  modified_base (409)..(409): a, c, t, g, unknown or other
  modified_base (463)..(463): a, c, t, g, unknown or other
  modified_base (608)..(608): a, c, t, g, unknown or other
aacgggtgagtaacacgtgggtgatctgccctgcactttgggataagcttgggaaactgggtctaataccgaatatgaccacttcttggatgttgtggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgaaggccttcgggttgtaaactcctttcgctatcgacgaagccacttgtggtgacggtnggtanataagaagcaccggctaactacgtgccagcagccgcggtnatacgtagggtgcaagcgttgtccggaattactgggcgtaaagagctcgtgggnggtttgtcgcgtcgtctgtgaaatcccggggcttaacttcgggcgtgcaggcgatacgggcataacttgagtgctgtaggggagactggaattactggtgttgcggggaaatgcgcatatatcaagacgaacacctatggcgaangcaggtctctgggcagtaactgactctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtaccggattgggctagagatagtctttcccttgtggtcggtatacaggtggtgcatggttgtcgtcagctcgtgtcgtgagatgttgggttaagtcccgcaacgagcgcaacccttgtcttatgttgccagcacgttatggtgggaactcatgagagactgccggggttaactcggaggaaggtggggatgacgtcaaatcatcatgccccttatgtccagggcttcacacatgctacaatggtcgatacaatgggcagcgacatcgtgaggtgaagcgaatccctgaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgt

SEQ ID NO: 691 - DNA, 1404 bp, Corynebacterium confusum
gagtttgatcctggctcaggacgaacgctggcggcgtgcttaacacatgcaagtcgaacggaaaggcttcagcttgctggagtactcgagtggcgaacgggtgagtaacacgtgggtgatctgccctgcacttcgggataagcctgggaaactgggtctaataccggataggaccgcactttggtgtgtgtggtggaaagttttttcggtgtaggatgagcccgcggcctatcagcttgttggtggggtaatggcctaccaaggcggcgacgggtagccggcctgagagggtggacggccacattgggactgagatacggcccagactcctacgggaggcagcagtggggaatattgcacaatgggcggaagcctgatgcagcgacgccgcgtgggggatgacggccttcgggttgtaaactcctttcgccagggacgaagcgtttttgtgacggtacctggataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcaggcttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagacccttccacgggttttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatttaggttcgcggcagagatgtcgtttccctttgtggcctttatacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcaatacaatgcgttgcgacactgtgaggtggagctaatcgcttaaagttggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaa

SEQ ID NO: 692 - DNA, 1483 bp, Corynebacterium coyleae
  modified_base (29)..(29): a, c, t, g, unknown or other
  modified_base (51)..(51): a, c, t, g, unknown or other
  modified_base (59)..(59): a, c, t, g, unknown or other
  modified_base (108)..(108): a, c, t, g, unknown or other
  modified_base (362)..(362): a, c, t, g, unknown or other
  modified_base (959)..(959): a, c, t, g, unknown or other
  modified_base (962)..(962): a, c, t, g, unknown or other
atgaacgctggcggcgtgcttaacacatncaagtcgaacggaaaggcctcngcttgcangggtactcgagtggcgaacgggtgagtaacacgtgggtgatctgccccncacttcgggataagcctgggaaactgggtctaataccggataggaccacttcttggaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcancgacgccgcgtgggggatgacggccttcgggttgtaaactcctttcgctagggacgaagcgcaagtgacggtacctagagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgncgnagagatgcgctttccctttgtggttggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgtttgcgagcctgtgagggtgtgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaatgcggctggatcacctcc

SEQ ID NO: 693 - DNA, 1529 bp, Corynebacterium diphtheriae
tttttatggagagtttgatcctggctcaggacgaacgctggcggcgtgcttaacacatgcaagtcgaacggaaaggcctagcttgctaggtactcgagtggcgaacgggtgagtaacacgtgggtgatctgcctcgtacttcgggataagcctgggaaactgggtctaatactggataggaccatgctttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctactggaggcagcagtggggaatattgcacaatgggcgcaagcctgatgcagcgacgccgcgtgggggatgacggccttcgggttgtaaacctctttcgctagggacgaagcttttgtgacggtacctagataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcggcgtagtgatacgttttcccttgtggtctgtatacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgctgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaacccttgtggggggagctgtcgaaggtgggatcggcgattgggacgaagtcgtaacaaggtagccgtaccggaaggtgcggctggatcacctcctttctaaggag

SEQ ID NO: 694 - DNA, 1420 bp, Corynebacterium durum
ctcaggacgaacgctggcggcgtgcttaacacatgcaagtcgaacgaaaagccctgccaccttggtggtgggtactcgagtggcgaacgggtgagtaacacgtgggtgatctgccccgcactgtgggataagcctgggaaactgggtctaataccacatacgaccatggcgtaggggtcatggtggaaagccttattgcggtgtgggatgagcccgcggcctatcagcttgttggtggggtaatggcctaccaaggcggcgacgggtagccggcctgagagggtggacggccacattgggactgagacacggcccagactctacgggaggcagcagtggggaatattgcacaatgggcgcaagcctgatgcagcgacgccgcgtgggggatkgaaggcttcgggttgtaaactcctttcgcccgggacgaagcccacctggtgggtgacggtaccgtggagaagaagcaccggctaactacgtgccagcagccgcggtaatacgtagggtgcaagcgttgtccggatttactgggcgtaaagagctcgtaggtggtgtgtcgcgtcgtctgtgaaattccggggcttaactccgggcgtgcaggcgatacgggcacgactagagtgctgtaggggtaactggaattcctggtgtagcggtgaaatgcgcagatatcaggaggaacaccgatggcgaaggcaggttactgggcagttactgacgctgaggagcgaaagcatggggagcgaacaggattagataccctggtagtccatgctgtaaacggtgggcgctaggtgtgggctgtgtgtttgcagtctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagatcggcgtagagatacgtcctcccttgtggttggtgcacaggtggtgcatggttgtcgtcagctcgtgtcgtgagatgttgggttaagtcccgcaacgagcgcaacccttgtcttatgttgccagcacatttttggtggggactcatgagaaactgccggggtcaactcggaggaaggtggggatgacgtcaaatcatcatgccctttatacccagggcttcacacatgctacaatggtcggtacaacgggttgcgacactgtgaagtgaagctaatctctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcctaacca

SEQ ID NO: 695 - DNA, 1524 bp, Corynebacterium efficiens
ttttgtggagagtttgatcctggctcaggacgaacgctggcggcgtgcttaacacatgcaagtcgaacgatgaagccctgcttgcagggtggattagtggcgaacgggtgagtaacacgtgggtgatctgccccgcacttcgggataagcctgggaaactgggtctaataccggatacgaccccctggtaggtcagggggtggaaagattttatcggtgtgggatgagcctgcggcctatcagcttgttggtggggtaatggcctaccaaggcgtcgacgggtagccggcctgagagggtgatcggccacattgggactgagacacggcccagactcctacgggaggcagcagtggggaatattgcacaatgggcgcaagcctgatgcagcgacgccgcgtgggggatgacggccttcgggttgtaaactcctttcgacagggacgaagcttttgtgacggtacctgtagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggacttccacgtcttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagatcgctgcagagatgtagcttcccttgtggctggtgtacaggtggtgcatggttgtcgtcagctcgtgtcgtgagatgttgggttaagtcccgcaacgagcgcaacccttgtcttatgttgccatcacgtgatggtgggcactcatgagagactgccggggttaactcggaggaaggtggggatgacgtcaaatcatcatgccccttatgtccagggcttcacacatgctacaatggtcggtacagcgagttgccacaccgtgaggtggagctaatctctcaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaacccgtaagggggggagctgtcgaaggtgggatcggcgattgggacgaagtcgtaacaaggtagccgtaccggaaggtgcggctggatcacctcctttct

SEQ ID NO: 696 - DNA, 1475 bp, Corynebacterium falsenii
cgaacgctggcggcgtgcttaacacatgcaagtcgaacggaaaggcccttgcttgcaggggtactcgagtggcgaacgggtgagtaacacgtgggtgatctgccttgtacttcgggataagcctgggaaactgggtctaataccggataggaccatgctttagtgtgtgtggtggaaagttttttcggtacaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgagggatgacggccttcgggttgtaaacctctttcgctagggaagaagccacttgtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaactccgggcgtgcaggcgatacgggcataactggagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtggggatctttctacgatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgctgcagagatgtagtttcccttgtggtctgtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagagggtcgcgataccgtgaggtggagctaatccctgaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggt

SEQ ID NO: 697 - DNA, 1489 bp, Corynebacterium flavescens
atcgtggagagtttgatcctggctcaggacgaacactggcggcgtgcttaacacatgcaagtcgaacggaaagacccctagcttgctgggggtactcgagtggcgaacgggtgagtaacacgtgggtgatctgccctgcacttcgggataagcttgggaaactgggtctaataccggatatgaacggtctttggtgtgattgttggaaagattttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagccttttttaaggtgacggtacctggataagaagcaccggctaactacgtgccagcagccgcggtaatacgtagggtgcaagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggattgggtcagagatggcttgtcccttgtggtctgtatacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggatgacgtcaaatcatcatgccccttatgtccagggcttcacacatgctacaatggtcggtacaatgcgttgcgatactgtgaggtggagcgaatcgtgtaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaa

SEQ ID NO: 698 - DNA, 1529 bp, Corynebacterium genitalium
tttttgtggagagtttgatcctggctcaggatgaacgctggcggcgtgcttaacacatgcaagtcgaacggaaaggccgaagcttgcttcggtactcgagtggcgaacgggtgagtaacacgtgggtgatctgccctgcactttgggataagcctgggaaactgggtctaataccagataggaccacgtcttggatggtgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtcagtgacggtacctggataagaagcaccggctaactacgtgccagcagccgcggtaatacgtagggtgcgagcgttgtccggaattactgggcgtaaagagctcgtaggtggtttgtcgcgtcgtttgtgtaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagcttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagctacttcgtgaggaggcgctaatcgctctaaagccggccttagttcggattggggtctgcaactcgaccccatgaagtcggagtcgctagtaatcgtagatcagcaacgctgcggtgaatacgttcccgggccttgtacacaccgcccgtcacgtcatgaaagttggtaacacccgaagccagtggcccaaacttgttagggagctgtcgaaggtgggatcggcgattgggacgaagtcgtaacaaggtagccgtaccggaaggtgcggctggatcacctcctttctaaggagc

SEQ ID NO: 699 - DNA, 1466 bp, Corynebacterium glaucum
ggcgtgctaacacatgcaagtcgaacggaaaggccgaagcttgctttggtactcgagtggcgaacgggtgagtaacacgtgggtgatctgccctgcactttgggataagcctgggaaactgggtctaataccagataggaccacggtgtggtgatcgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaataccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgcagagatgtggtttcccttgtggttggtgtacaggtggtgcatggttgtcgtcagctcgtgtcgtgagatgttgggttaagtcccgcaacgagcgcaacccttgtcttatgttgccagcatgttgtggtggggactcatgagagactgccggggttaactcggaggaaggtggggatgacgtcaaatcatcatgccccttatgtccagggcttcacacatgctacaatggtcggtacaacgcgcttgcgagcctgtgagggtgagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacgaagtcgtaacaaggtagccgtaccggaaggtgcggctggatcacct

SEQ ID NO: 700 - DNA, 1533 bp, Corynebacterium glucuronolyticum
ttttgttggagagtttgatcctggctcaggatgaacgctggcggcgtgcttaacacatgcaagtcgaacggaaaggctccagcttgctggggtgctcgagtggcgaacgggtgagtaacacgtaagtgatctgccctgcactgggggataagcttgggaaactgggtctaataccctataggaccgcatcgtggttggtgtggtggaaaggtttttctggtgtgggatgagcttgcggcctatcagcttgttggtggggtaatggcctaccaaggcggcgacgggtagccggcctgagagggtgtgcggccacattgggactgagatacggcccagactcctacgggaggcagcagtggggaattttgcacaatgggcggaagcctgatgcagcgacgccgtgtgggggatgaaggccttcgggttgtaaactcctttcgtcagggacgaagtttttttgacggtacctggataagaagcaccggctaactacgtgccagcagccgcggtaatacgtagggtgcgagcgttgtccggatttactgggcgtaaagggctcgtaggtggtgtgtcgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacaggattagataccctggtagtctatgctgtaaacggtgggcgctaggtgtgagtcccttccacggggtttgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacatatgtgagattgggctagagatagttcgtcccttgtggctcatttacaggtggtgcatggttgtcgtcagctcgtgtcgtgagatgttgggttaagtcccgcaacgagcgcaacccttgtcttatgttgccagcacgttgtggtggggactcgtgagagactgccggggttaactcggaggaaggtggggatgacgtcaaatcatcatgccccttatgtccagggcttcacacatgctacaatggctggtacagtgcgtgtgcgacaccgtgaggtggagctaatcgcgaaagccagtctcagttcggattggggtctgcaactcgaccccatgaagtcggagtcgctagtaatcgcagatcagcagtgctgcggtgaatacgttcccgggccttgtacacaccgcccgtcacgtcatgaaagttggtaacacccgaagcccatggcccaaccggttttccggggggagtggtcgaaggtgggattggcgattgggacgaagtcgtaacaaggtagccgtaccggaaggtgcggctggatcacctcctttctaagg

SEQ ID NO: 701 - DNA, 1525 bp, Corynebacterium glutamicum
tgtggagagtttgatcctggctcaggacgaacgctggcggcgtgcttaacacatgcaagtcgaacgctgaaaccggagcttgctttggtggatgagtggcgaacgggtgagtaacacgtgggtgatctgccctacactttgggataagcctgggaaactgggtctaataccgaatattcacaccaccgtaggggtggtgtggaaagccttgtgcggtgtgggatgagcctgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgggggatgaaggccttcgggttgtaaactcctttcgctagggacgaagccttttaggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggtcttccacgacttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatggaccggatcggcgtagagatacgttttcccttgtggtcggttcacaggtggtgcatggttgtcgtcagctcgtgtcgtgagatgttgggttaagtcccgcaacgagcgcaacccttgtcttatgttgccagcacattgtggtgggtactcatgagagactgccggggttaactcggaggaaggtggggatgacgtcaaatcatcatgccccttatgtccagggcttcacacatgctacaatggtcggtacagcgagttgccacaccgtgaggtggagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaccttttaggggggagctgtcgaaggtgggatcggcgattgggacgaagtcgtaacaaggtagccgtaccggaaggtgcggctggatcacctcctttct

SEQ ID NO: 702 - DNA, 1489 bp, Corynebacterium hansenii
gctggcggcgtgcttaacacatgcaagtcgaacggtaaggccccagcttgctggggtacacgagtggcgaacgggtgagtaacacgtgggtgacctgccccgcacttcgggataagcctgggaaactgggtctaataccggataggaccgcatcgttgggatgtggtggaaagttttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggctcaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtacgggatcgggccagagatggtctttcccttgtggctcgtatacaggtggtgcatggttgtcgtcagctcgtgtcgtgagatgttgggttaagtcccgcaacgagcgcaacccttgtcttatgttgccagcacgttatggtggggactcgtgagaaactgccggggtcaactcggaggaaggtggggatgacgtcaaatcatcatgccccttatgtccagggcttcacacatgctacaatggtcggtacagtgggttgcgatgccgtgaggcggagctaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcccaaccttttttggggggagctgtcgaaggtgggatcggcgattgggacgaagtcgtaacaaggtagccgtaccggaaggtgcggctggatcacctcctttct

SEQ ID NO: 703 - DNA, 1460 bp, Corynebacterium imitans
aacgctggcggcgtgcttaacacatgcaagtcgaacggaaaggccgaagcttgcttcggtactcgagtggcgaacgggtgagtaacacgtgggtgatctgccctgtacttcgggataagcttgggaaactgggtctaataccggatatgacaatctcttggatggggttgtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagcttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgtttgcgagctcgtgagggtgggctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacgtgttagggagtggtcgaaggtgggatcggcgattgggacgaagtcgtaacaaggtagccgtac

SEQ ID NO: 704 - DNA, 1532 bp, Corynebacterium jeikeium
tttttatggagagtttgatcctggctcaggacgaacgctggcggcgtgcttaacacatgcaagtcgaacggaaaggctccttgcttgcaaggggtactcgagtggcgaacgggtgagtaacacgtgggtgatctgccttgcacttcgggataagcctgggaaactgggtctaataccggataggaccatgctttagtgtgtgtggtggaaagttttttcggtgcaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaactcctttcgctagggaagaagccactgtgtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataactagagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtgggggttttatttacgattcccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgcgataccgtgaggtggagctaatcccttaaagccggtctcagttcggattggagtctgcaactcgactccatgaagtcggagtcgctagtaatcgcagatcagcaacgctgcggtgaatacgttcccgggccttgtacacaccgcccgtcgcgtcatgaaagttggtaacacccgaagccagtggcccaaacttgttagggagctgtcgaaggtgggattggcgattgggacgaagtcgtaacaaggtagccgtaccggaaggtgcggctggatcacctcctttct

SEQ ID NO: 705 - DNA, 1400 bp, Corynebacterium kroppenstedtii
  modified_base (1077)..(1077): a, c, t, g, unknown or other
cctggctcaggacgaacgctggcggcgtgcttaacacatgcaagtcgaacggaaaggccctgcttgcagggtgctcgagtggcgaacgggtgagtaacacgtgggtgatctgccccttactttgggataagcctgggaaactgggtctaatactggataggaccatgctgtaggtggtgtggtggaaagattttttcggtaagggatgagctcgcggcctatcagcttgttggtggggtaatggcctaccaaggcgtcgacgggtagccggcctgagagggtggacggccacattgggactgagatacggcccagattcctacgggaggcagcagtggggaatattgcacaatgggcgcaagcctgatgcagcgacgccgcgtgggggatgacggccttcgggttgtaaactcctttcagccatgacgaagcccttgtggtgacggtagtggtagaagaagcaccggctaactacgtgccagcagccgcggtaatacgtagggtgcgagcgttgtccggaattactgggcgtaaagagctcgtaggtggtctgtcgcgtcatttgtgaaagcccggggcttaactccgggttggcaggtgatacgggcatgactggagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggatgcggccagagatggttgttccctttgtggctggtgtgcaggtggtgcatggttgtcgtcagctcgtgtcgtgagatgttgggttaagtcccgcaacgagcgcaaccnttgtctcgtgttgccagcatttggttggggactcgcgggagactgccggggttaactcggaggaaggtggggatgacgtcaaatcatcatgccccttatgtccagggcttcacacatgctacaatggctggtacagagagttgcgataccgtgaggtggggctaatctcttaaagccagtctcagttcggattggagtctgcaactcgactccatgaagtcggagtcgctagtaatcgcagatcagcaatgctgcggtgaatacgttcccgggccttgtacacaccgcccgtcacgtcatgaaagttggtaacacccgaagcc

SEQ ID NO: 706 - DNA, 1532 bp, Corynebacterium lipophiloflavum
tttttgtggagagtttgatcctggctcaggatgaacgctggcggcgtgcttaacacatgcaagtcgaacggaaaggccacagcttgctgtggtactcgagtggcgaacgggtgagtaacacgtgggtgatctgccctgtacttcgggataagcttgggaaactgggtctaataccggatatgaccactttttggatggggtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtaagtgacggtacctggataagaagcaccggctaactacgtgccagcagccgcggtaatacgtagggtgcgagcgttgtccggaattactgggcgtaaagagctcgtaggtggtttgtcgcgtcgtttgtgtaagtccacggcttaactgtgggatggcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgtgtgcgacactgtgaggtgaagctaatcgctctaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacgtgttagggagctgtcgaaggtgggatcggcgattgggacgaagtcgtaacaaggtagccgtaccggaaggtgcggctggatcacctcctttctaaggagc

SEQ ID NO: 707 - DNA, 1334 bp, Corynebacterium macginleyi
gagtttgatcmtggctcaggacgaacgctggcggcgtgcttaacacatgcaagtcgaacgagtggcgaacgggtgagtaacacgtgggtgatctgccctgcacttcgggataagcttgggaaactgggtctaataccggatagggaaagtcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgatgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcaaacttgagtgctgtaggggtaactggaattcctggtgtagcggtgaaatgcgcagatatcaggaggaacaccgatggcgaaggcaggttactgggcagactgacgctgaggagcgaaagcatgggtagcgaacaggattagataccctggtagtccatgctgtaaacggtgggcgctaggtgtgagggttctcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcatggggactcatgagagactgccggggttaactcggaggaaggtggggatgacgtcaaatcatcatgccccttatgtccagggcttcacacatgctacaatggtcggcaacgcgttgcgacactgtgaggtggagcgaatcgctgccggtcttagttcggatggggtctgcaactcgaccccagaagtcggagtcgctagtaatcgcagatcagcaatgctgcggtgaatacgttcccgggccttgtacacaccgcccgtcacgtcatgaaagttggtaacacccgaagccggtgcctagggagccgtcgaaggtgggattggcgattgggacgaagtcgtaacaaggtakcc

SEQ ID NO: 708 - DNA, 1336 bp, Corynebacterium mastitidis
gagtttgatcmtggctcaggacgaacgctggcggcgtgcttaacacatgcaagtcgaacgagtggcgaacgggtgagtaacacgtgggtgatctgccctcaacttcgggataagcttgggaaactgggtctaataccggatagggaaagtcggttggggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctaccgacgatgacggtaggtggagaagaagcaccggctaactacgtgccagcagccgcggtaatacgtagggtgcgagcgttgtccggatttactgggcgtaaagagctcgtaggtggtttgtcgcgtcgtctgtgaaattccggggcttaacttcgggcgtgcaggcgatacgggcaaacttgagtgctgtaggggtaactggaattcctggtgtagcggtggaatgcgcagatatcaggaggaacaccgatggcgaaggcaggttactgggcagactgacgctgaggagcgaaagcatgggtagcgaacaggattagataccctggtagtccatgctgtaaacggtgggcgctaggtgtgagccggtttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggtggtgcatggttgtcgtcagctcgtgtcgtgagatgttgggttaagtcccgcaacgagcgcaacccttgtcttatgttgccagcacgtggggactcatgagagactgccggggttaactcggaggaaggtggggatgacgtcaaatcatcatgccccttatgtccagggcttcacacatgctacaatggtcggcagtaggttgcgataccgtgaggtggagctaatcctgttcggccttagttcggatggggtctgcaactcgaccccagaagtcggagtcgctagtaatcgcagatcagcaacgctgcggtgaatacgttcccgggccttgtacacaccgcccgtcacgtcatgaaagttggtaacacccgaaaaccatgcctagggagtggttgaaggtgggattggcgattgggacgaagtcgtaacaaggtakcc

SEQ ID NO: 709 - DNA, 1559 bp, Corynebacterium matruchotii
tttttttggagagtttgatcctggctcaggacgaacgctggcggcgtgcttaacacatgcaagtcgaacggaaaggcccccacttttttggtgggggtgctcgagtggcgaacgggtgagtaacacgtgggtgatctgccctgcacttcgggataagcttgggaaactgggtctaataccggataggaccatggtttagtgtctcatggtggaaagattattgttttggtgcaggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgttagggacgaagccrcacctkttttgggtgtggtgacggtacctttgttaagaagcaccggctaactacgtgccagcagccgcggtaatacgtagggtgcgagcgttgtccggaattactgggcgtaaagagctcgtaggtggtttgttgcgtcgtctgtgaaattccggggcttaacttcggggtggcaggcgatacgggcataactagagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgctgtaaacggtgggcgttaggtgtggggaccggtttggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagacggttgtagagatacgtacctccctttgtggttggtgtgcaggtggtgcatggttgtcgtcagctcgtgtcgtgagatgttgggttaagtcccgcaacgagcgcaacccttgtcttatgttgccagcactttgggtggggactcatgagagactgccggggttaactcggaggaaggtggggatgacgtcaaatcatcatgccctttatgcccagggcttcacacatgctacaatggttagtacaacgcgctgcaaacctgtgagggtgagcgaatcgctgaaagctaatctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccaccgttttttggtggggggagtggtcgaaggtgggattggcgattgggacgaagtcgtaacaaggtagccgtaccggaaggtgcggctggatcacctcctttct

SEQ ID NO: 710 - DNA, 1400 bp, Corynebacterium minutissimum
  modified_base (49)..(52): a, c, t, g, unknown or other
  modified_base (59)..(61): a, c, t, g, unknown or other
  modified_base (188)..(188): a, c, t, g, unknown or other
  modified_base (426)..(427): a, c, t, g, unknown or other
  modified_base (832)..(832): a, c, t, g, unknown or other
  modified_base (884)..(884): a, c, t, g, unknown or other
  modified_base (1395)..(1396): a, c, t, g, unknown or other
acgaacgctggcggcgtgcttaacacatgcaagtcgaacggaaaggccnnnngcttgcnnngggtactcgagtggcgaacgggtgagtaacacgtgggtgatctgccttgcactctgggataagcttgggaaactgggtctaataccggataggaaccgtctttagtgtggtggttggaaagtttttncggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagcgnnagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtagggggcttccacgtcttctgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgtagatcagcaatgctgcggtgaatacgttcccgggccttgtacacaccgcccgtcacgtcatgaaagttggtaacacccgaacgcagtggctnnaact

SEQ ID NO: 711 - DNA, 1459 bp, Corynebacterium mucifaciens
  modified_base (354)..(354): a, c, t, g, unknown or other
  modified_base (385)..(385): a, c, t, g, unknown or other
  modified_base (1092)..(1092): a, c, t, g, unknown or other
ggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggacgatggtttggatgccattgtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagngacgccgcgtgggggatgacggccttcgggntgtaaactcctttcgctagggacgaagcgttttgtgacggtacctggagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgtagagatacggtttccctttgtggttggtgtacaggtggtgcatggttgtcgtcagctcgtgtcgtgagatgttgggttaagtcccgcaacgagcgcaacccttgtcttatgttgccagcagctgatggtggggactcntgagagactgccggggttaactcggaggaaggtggggatgacgtcaaatcatcatgccccttatgtccagggcttcacacatgctacaatggtcggtacaacgcgcatgcgagcctgtgaggtggagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacagtcatgaaagttggtaacacccgaagccagtggcctgttacagggagctgtgtcgaaggtgggatcggcgattgggacgaagtcgtaacaaggtagccgtaccgg

SEQ ID NO: 712 - DNA, 1443 bp, Corynebacterium propinquum
  modified_base (16)..(16): a, c, t, g, unknown or other
ctgctcaggacgaacnctggcggcgtgcttaacacatgcaagtcgaacggaaaggccttttcggaggtactcgagtggcgaacgggtgagtaacacgtgggtgatctgccctgcactctgggataagcctgggaaactgggtctaataccggataggactgcactttagtgtgtgtggtggaaagttttttcggtgtaggatgagcccgcggcctatcagcttgttggtggggtaatggcctaccaaggcggcgacgggtagccggactgagaggttggtcggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttttgtgacggtacctggagaagaagcaccggctaactacgtgccagcagccgcggtaatacgtagggtgcaagcgttgtccggaattactgggcgtaaagagctcgtaggtggtttgtcgcgtcgtctgtgaaattccacagcttaactgtgggcgtgcaggcgatacgggctgacttgagtactgtaggggtaactggaattcctggtgtagcggtgaaatgcgcagatatcaggaggaacaccgatggcgaaggcaggttactgggcagttactgacgctgaggagcgaaagcatgggtagcaaacaggattagataccctggtagtccatgccgtaaacggtgggcgctaggtgtaggggccttttggggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttcccttgtggctggtgtacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggacgacgtcaagtcatcatgccccttatgtccagggcttcacacatgctacaatggccggtacaatgcgcagcgagcctgtgagggtgagctaatcgcttaaagccggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggctcaaactcggtttagggagccgtcgaaggtgggatcggcgattgg

SEQ ID NO: 713 - DNA, 1483 bp, Corynebacterium pseudodiphtheriticum
cctggctcaggacgaacgctggcggcgtgcttaacacatgcaagtcgaacggaaaggcctcttcggaggtactcgagtggcgaacgggtgagtaacacgtgggtgatctgccctgcactctgggataagcctgggaaactgggtctaataccggataggaccatgctttagtgtgtgtggtggaaagttttttcggtgtaggatgagcccgcggcctatcagcttgttggtggggtaatggcctaccaaggcggcgacgggtagccggactgagaggttggtcggccacattgggactgagatacggcccagactcctacgggaggcagcagtggggaatattgcacaatgggcgcaagcctgatgcagcgacgccgcgtgggggatgacggccttcgggttgtaaactcctttcggcagggacgaagcgttttgtgacggtacctggagaagaagcaccggctaactacgtgccagcagccgcggtaatacgtagggtgcaagcgttgtccggaattactgggcgtaaagagctcgtaggtggtttgtcacgtcgtctgtgaaattccacagcttaactgtgggcgtgcaggcgatacgggctgacttgagtactgtaggggtaactggaattcctggtgtagcggtgaaatgcgcagatatcaggaggaacaccgatggcgaaggcaggttactgggcagttactgacgctgaggagcgaaagcatgggtagcaaacaggattagataccctggtagtccatgccgtaaacggtgggcgctaggtgtagggaccttttggggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgctgcagagatgtagtttcccttgtggctagtgtacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggacgacgtcaagtcatcatgccccttatgtccagggcttcacacatgctacaatggccggtacaatgcgcagcgagcctgtgagggtgagctaatcgcttaaagctggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggctcaaactcgtttagggagccgtcgaaggtgggatcggcgattgggacgaagtcgtaacaaggtagccgtaccggaaggtgcgg

SEQ ID NO: 714 - DNA, 1529 bp, Corynebacterium pseudogenitalium
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttctaaggagc

SEQ ID NO: 715 - DNA, 1396 bp, Corynebacterium pseudotuberculosis
  modified_base (827)..(827): a, c, t, g, unknown or other
  modified_base (879)..(879): a, c, t, g, unknown or other
acgaacgctggcggcgtgcttaacacatgcaagtcgaacggaaaggccccttcgggggtgctcgagtggcgaacgggtgagtaacacgtgggtgatctgcctcgtactctgggataagcctgggaaactgggtctaatactggataggaccgcactttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatatacaagatcggcgtagagatacgttttcccttgtggtttgtatacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgttgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaacgccatggcccaacc

SEQ ID NO: 716 - DNA, 1409 bp, Corynebacterium pyruviciproducens
acgctggcggcgtgcttaacacatgcaagtcgaacggaaaggcctcagcttgctggggtgctcgagtggcgaacgggtgagtaacacgtaggtgatctgcctttcacttcgggataagcttgggaaactgggtctaataccggatattcactatgccgtggttggtgtggtggaaagcttttgcggtgggagatgagcttgcggcctatcagcttgttggtggggtaatggcctaccaaggcggcgacgggtagccggcctgagagggtgtgcggccacattgggactgagatacggcccagactcctacgggaggcagcagtggggaattttgcacaatgggcggaagcctgatgcagcgacgccgtgtgggggatgaaggccttcgggttgtaaactcctttcgtcagggacgaagtttgtttgacggtacctggataagaagcaccggctaactacgtgccagcagccgcggtaatacgtagggtgcgagcgttgtccggatttactgggcgtaaagggctcgtaggtggtgtgttgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacaggattagataccctggtagtctatgctgtaaacggtgggcgctaggtgtgagcctcttccacggggtttgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacataggcaggatgggcgcagagatgtgtcgtccctttgtggtctgtttacaggtggtgcatggttgtcgtcagctcgtgtcgtgagatgttgggttaagtcccgcaacgagcgcaacccttgtcttatgttgccagcacgttgtggtggggactcgtgagagactgccggggttaactcggaggaaggtggggatgacgtcaaatcatcatgccccttatgtccagggcttcacacatgctacaatggttggtacagtgcgtgagcaacatcgtgaggtggagctaatcgctaaagccagtctcagttcggattggggtctgcaactcgacctcatgaagtcggagtcgctagtaatcgcagatcagcagtgctgcggtgaatacgttcccgggccttgtacacaccgcccgtcacgtcatgaaagttggtaacacccgaagcccatggcctaaccggttttgccggg

SEQ ID NO: 717 - DNA, 1395 bp, Corynebacterium renale
  modified_base (830)..(830): a, c, t, g, unknown or other
  modified_base (882)..(882): a, c, t, g, unknown or other
  modified_base (1391)..(1391): a, c, t, g, unknown or other
acgaacgctggcggcgtgcttaacacatgcaagtcgaacggaaaggccactgcttgcagtggtactcgagtggcgaacgggtgagtaacacgtgggtgatctgccctgtactttgggataagcctgggaaactgggtctaataccggataggaccatcgtttagtgtcggtggtggaaagcttttgcggtacgggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgctagggacgaagcttttgtgacggtacctagagaagaagcaccggctaactacgtgccagcagccgcggtaatacgtagggtgcgagcgttgtccggatttactgggcgtaaagagctcgtaggtggtttgtcgcgtcgtctgtgaaattccggggcttaactccgggcgtgcaggcgatacgggcataacttgagtactgtaggggagactggaattcctggtgtagcggtggaatgcgcagatatcaggaggaacaccgatggcgaaggcaggtctctgggcagttactgacactgaggagcgaaagcatgggtagcgaacaggattagataccctggtagtccatgccgtaaacggtgggcgctaggtgtgagacccttccacgggttttgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggtttgacatacaccagaccgggccagagatggtctttccctttgtggttggtgtacaggtggtgcatggttgtcgtcagctcgtgtcgtgagatgttgggttaagtcccgtaacgagcgcaacccttgtcttatgttgccagcacgttgtggtggggactcatgagagactgccggggttaactcggaggaaggtggggatgacgtcaaatcatcatgccccttatgtccagggcttcacacatgctacaatggtcggtacaacgcgtgtgctacttcgtgaggagatgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaacgccntggc

SEQ ID NO: 718 - DNA, 1320 bp, Corynebacterium resistens
aaagttttttcggtacgagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcggaagcctgatgcagcgacgccgcgtgagggatgacggccttcgggttgtaaacctctttcgctagggaagaagcctttttggtgacggtacctggataagaagcaccggctaactacgtgccagcagccgcggtaatacgtagggtgcaagcgttgtccggaattactgggcgtaaagagctcgtaggtggtttgtcgcgtcgttagtgaaagcccggggcttaactccgggtctgctggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtttttcacgacttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacgggatcggcgtagagatacgttttcccttgtggctcgtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgcgatgccgtgaggtggagctaatcccttaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggtgcggctggatcacctcctttct

SEQ ID NO: 719 - DNA, 1457 bp, Corynebacterium riegelii
atgaacgctggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggaccacttcgtagktgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaagtccacggcttaactgtgggactgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcacgtgatggtggggacttatgagaaactgccggggttaactcggaggaaggtggggatgacgtcaaatcatcatgccccttatgtccagggcttcacacatgctacaatggtcggtacaacgcgcagctacctcgtgaggggacgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacaagtcgtaacaaggtagccgtaccgg

SEQ ID NO: 720 - DNA, 1469 bp, Corynebacterium simulans
gacgaacgctggcggcgtgcttaacacatgcaagtcgaacggaaaggcctcagcttgctggggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatagcggatcgctgcagagatgtagtttccctttgtggtcgttatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaagg

SEQ ID NO: 721 - DNA, 1323 bp, Corynebacterium singulare
  modified_base (922)..(922): a, c, t, g, unknown or other
  modified_base (1086)..(1086): a, c, t, g, unknown or other
acgaacgctggcggcgtgcttaacacatgcaagtcgaacggaaaggccctagcttgctgaggtgctcgagtggcgaacgggtgagtaacacgtgggtgatctgccttgtactctgggataagcttgggaaactgggtctaataccggataggaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacncgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcatttngttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgtagatcagcaatgctgcggtga

SEQ ID NO: 722 - DNA, 1475 bp, Corynebacterium sp. 1 ex sheep
gacgaacgctggcggcgtgcttaacacatgcaagtcgaacggaaaggcccctagcttgctgggggtactcgagtggcgaacgggtgagtaacacgtgggtgatctgccctgcacttcgggataagcctgggaaactgggtctaataccggataggagccatctttggtgtgatggttggaaagttttttcggtgtaggatgagcctgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttttgtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtaccagatcgccatagagatatggtttcccttgtggctggttcacaggtggtgcatggttgtcgtcagctcgtgtcgtgagatgttgggttaagtcccgcaacgagcgcaacccttatcttatgttgccagcacgtagtggtggggactcatgagagactgccggggtcaactcggaggaaggtggggatgacgtcaaatcatcatgccccttatgtccagggcttcacacatgctacaatggtcggtacaacgcgcagcgagactgtgaggttaagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggcccaaactcgtttagggagctgtcgaaggtgggatcggcgattgggacgaagtcgtaacaaggtagccgtaccggaagg

SEQ ID NO: 723 - DNA, 1491 bp, Corynebacterium sp. L-2012475
gaacgctggcggcgtgcttaacacatgcaagtcgaacggaaaggctcaagcttgcttgggtactcgagtggcgaacgggtgagtaacacgtgggtgatctgccctgcactttgggataagcctgggaaactgggtctaataccggataggaccatcgtttagtgtcggtggtggaaagtttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaggacgaagaggaattgacggtacttggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgcagcttccctgtgagggggtgcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaacgtgttagggagctgtcgaaggtgggatcggcgattgggacgaagtcgtaacaaggtagccgtaccggaaggtgcggctggatcaccttctttcta

SEQ ID NO: 724 - DNA, 1445 bp, Corynebacterium sp. NML 93-0481
catgcaagtcgaacggaaaggctccagcttgctggggtactcgagtggcgaacgggtgagtaacacgtgggtgatctgccctgcacttcgggataagcctgggaaactgggtctaataccggataggaccacttctttgaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgtcagggacgaagcgaaagtgacggtacctggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgttgctacttcgtgaggagatgctaatcgctaaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaactcgttagggagctgtcgaaggtgggatcggcgattgggacgaagtcgtaacaaggtagccgtaccggaaggtg

SEQ ID NO: 725 - DNA, 1457 bp, Corynebacterium sp. NML 97-0186
catgcaagtcgaacggaaaggccagtgcttgcactggtactcgagtggcgaacgggtgagtaacacgtgggtgatctgccctcaactccgggataagcctgggaaactgggtctaatactggataggaccacatcgtaggtggtgtggtggaaagcgtttgtagcggttggggatgagctcgcggcctatcagcttgttggtggggtaatggcctaccaaggcggcgacgggtagccggcctgagagggtgtacggtcacattgggactgagatacggcccagactcctacgggaggcagcagtggggaatattgcacaatgggcgcaagcctgatgcagcgacgccgcgtgggggatgacggccttcgggttgtaaacctctttcgaccgtgacgaagcctttggtgacggtagcggtagaagaagcaccggctaactacgtgccagcagccgcggtaatacgtagggtgcgagcgttgtccggatttactgggcgtaaagggctcgtaggtggtttgtcgcgtcgtctgtgaaattccggggctcaactccgggcgtgcaggcgatacgggcataacttgagtactgcaggggtaactggaattcctggtgtagcggtggaatgcgcagatatcaggaggaacaccgatggcgaaggcaggttactgggcagttactgacgctgaggagcgaaagcatgggtagcgaacaggattagataccctggtagtccatgctgtcaacggtgggcgctaggtgtgagacccttccacgggttttgtgccgtagctaacgttttaagcgccccgcctggggagtacggccgcaaggctaaaactcaaaggaattgacgggggcccgcacaagcggcggagcatgtggattaattcgatgcaacgcgaagaaccttacctgggtttgacatacactggatcgcctcggagacggggtttccctttgtggtcggtgtacaggtggtgcatggttgtcgtcagctcgtgtcgtgagatgttgggttaagtcccgcaacgagcgcaacccttgtcctgtgttgccagcacgttgtggtggggactcacgggagactgccggggtgaactcggaggaaggtggggatgacgtcaaatcatcatgccccttatgtccagggcttcacacatgctacaatggtcggtacaacaggttgcgataccgtgaggtggagctaatccttttaaagccggcctcagttcggattggggtctgcaactcgaccccatgaagtcggagtcgctagtaatcgcagatcagcagtgctgcggtgaatacgttcccgggccttgtacacaccgcccgtcacgtcatgaaagtcggtaacacccgaagcccacggcccaacccttgtggggggagtggtcgaaggtgggatcggcgattgggacgaagtcgtaacaaggtagccgtaccggaaggtgcg

SEQ ID NO: 726 - DNA, 1453 bp, Corynebacterium sp. NML 99-0018
catgcaagtcgaacggaaaggcctctagcttgctaggggtactcgagtggcgaacgggtgagtaacacgtgggtgatctgccctgcactttgggataagcttgggaaactgggtctaataccgaatatgaccattgtttggatgcgatggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtttttgtgacggtacctggataaraagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcaratatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtacaggatcgggctagagatagtctttcccttgtggtctgtatacaggtggtgcatggttgtcgtcagctcgtgtcgtgagatgttgggttaagtcccgcaacgagcgcaayccttgtcttatgttgccagcacgttatggtggggactcatgagagactgccggggttaactcggaggaaggtggggatgacgtcaaatcatcatgccccttatgtccagggcttcacacatgctacaatggtcgatacagtgggcagcgacatcgtgaggtggagcgaatccctgaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcg

SEQ ID NO: 727 - DNA, 1522 bp, Corynebacterium striatum
tttttgtggagagtttgatcctggctcaggacgaacgctggcggcgtgcttaacacatgcaagtcgaacggaaaggcctgcagcttgctgcgggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcgtaagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagacaggcgtagagatacgtcctcccttgtggtttgtatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaaggtgcggctggatcacctcctttct

SEQ ID NO: 728 - DNA, 1468 bp, Corynebacterium sundsvallense
gatgaacgctggcggcgtgcttaacacatgcaagtcgaacggaaaggccagtgcttgcactggtgctcgagtggcgaacgggtgagtaacacgtgagtgatctgccctgcactttgggataagcctgggaaactgggtctaataccggataggaccatgctttagatggtgtggtggaaagttttttcggtgtgggatgagcttgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaactgacgaagctttgtgtgacggtaggttgagaagaagcaccggctaactacgtgccagcagccgcggtaatacgtagggtgcgagcgttgtccggaattactgggcgtaaagagctcgtaggtggtttgtcgcgtcgtgtgtgaaattccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgaggcccttccacgggtttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccgaatcgctgcagagatgtggtttcccttgtggttggtgtacaggtggtgcatggttgtcgtcagctcgtgtcgtgagatgttgggttaagtcccgcaacgagcgcaacccttgtcttatgttgccagcatgttgtggtgggcacttatgagagactgccggggttaactcggaggaaggtggggatgacgtcaaatcatcatgccccttatgtccagggcttcacacatgctacaatggtcggtacaacgcgcagctacctcgtgaggggacgcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtgaaaaggagctgtcgaaggtgggatcggcgattgggacgaagtcgtaacaaggtagccgtaccggaagg

SEQ ID NO: 729 - DNA, 1522 bp, Corynebacterium tuberculostearicum
tttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttct

SEQ ID NO: 730 - DNA, 1502 bp, Corynebacterium tuscaniae
  modified_base (674)..(674): a, c, t, g, unknown or other
agagtttgatcctggctcaggatgaacgctggcggcgtgcttaacacatgcaagtcgaacggaaaggcccaagcttgcttgggtgctcgagtggcgaacgggtgagtaacacgtgggtgatctgccctgcacttcgggataagcctgggaaactgggtctaataccggataggaccatcgtgttgtggcggtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttatgtgacggtacctggataagaagcaccggctaactacgtgccagcagccgcggtaatacgtagggtgcgagcgttgtccggaattactgggcgtaaagagctcgtaggtggtttgtcgcgtcgtttgtgtaataccgcagcttaactgtggggttgcaggcgatacgggcataacttgagtgctgtaggggagactggaattcctggtgtagcggtggaatgcgcanatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagctactctgtgaggggatgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacgtgttagggagctgtcgaaggtgggatcggcgattgggacgaagtcgtaacaaggtagccgtaccggaaggtgcggctggatc

SEQ ID NO: 731 - DNA, 1508 bp, Corynebacterium ulcerans
agagtttgatcctggctcaggacgaacgctggcggcgtgcttaacacatgcaagtcgaacggaaaggccccttcgggggtactcgagtggcgaacgggtgagtaacacgtgggtgatctgcctcgtactctgggataagcctgggaaactgggtctaatactggataggaccgcactttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggcctcgggttgtaaacctctttcgacagggacgaagcttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagatcggcgtagagatacgttttcccttgtggtttgtatacaggtggtgcatggttgtcgtcagctcgtgtcgtgagatgttgggttaagtcccgcaacgagcgcaacccttgtcttatgttgccagcacgttatggtggggactcatgagagactgccggggttaactcggaggaaggtggggatgacgtcaaatcatcatgccccttatgtccagggcttcacacatgctacaatggtcggtacaacgcgttgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccagtttgtctggggggagtggtcgaaggtgggatcggcgattgggacgaagtcgtaacaaggtagccgtaccggaaggtgcggctggatcacct

SEQ ID NO: 732 - DNA, 1401 bp, Corynebacterium urealyticum
  modified_base (830)..(830): a, c, t, g, unknown or other
  modified_base (882)..(882): a, c, t, g, unknown or other
acgaacgctggcggcgtgcttaacacatgcaagtcgaacggaaaggcccctgcttgcagggtactcgagtggcgaacgggtgagtaacacgtgggtgatctgcccttcacttcgggataagcctgggaaactgggtctaataccggataggaccaatctttagtgtggttggtggaaagttttttcggtggaggatgagcccgcggcctatcagcttgttggtggggtaatggcctaccaaggcgacgacgggtagccggcctgagagggtggacggccacattgggactgagacacggcccagactcctacgggaggcagcagtggggaatattgcacaatgggcggaagcctgatgcagcgacgccgcgtgagggatgacggccttcgggttgtaaacctctttcgctagggaagaagccttcgggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcaaactggagtgctgtaggggagactggaattcctggtgtagcggtggaatgcgcagatatcaggaggaacaccgatggcgaaggcaggtctctgggcagttactgacactgaggagcgaaagcatgggtagcgaacaggattagataccctggtagtccatgccgtaaacggtgggcgctaggtgtggggatttttcacgatttccgtgccgtagctaacgcattaagcgcccngcctggggagtacggccgcaaggctaaaactcaaaggaattgacgggggccngcacaagcggcggagcatgtggattaattcgatgcaacgcgaagaaccttacctgggcttgacatacaccggatcgctgcagagatgtagtttcccttcggggctggtgtacaggtggtgcatggttgtcgtcagctcgtgtcgtgagatgttgggttaagtcccgtaacgagcgcaacccttgtcttgtgttgccagcacgttgtggtggggactcacaagagactgccggggttaactcggaggaaggtggggatgacgtcaaatcatcatgccccttatgtccagggcttcacacatgctacaatggtcgatacagtgggttgcgatgccgtgaggtggagctaatccctgaaagtcggcctcagttcggattggagtctgcaactcgactccatgaagtcggagtcgctagtaatcgcagatcagcaacgctgcggtgaatacgttcccgggccttgtacacaccgcccgtcgcgtcatgaaagttggtaacacccgaacgcagtggcctaaact

SEQ ID NO: 733 - DNA, 1480 bp, Corynebacterium ureicelerivorans
ggcgtgcttaacacatgcaagtcgaacggaaaggcccaagcttgcttgggtactcgagtggcgaacgggtgagtaacacgtgggtgatctgccctgcacttcgggataagcctgggaaactgggtctaatactggataggaccacttcttggatgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagcgtttttgtgacggtacctggagaagaagcaccggctaactacgtgccagcagccgcggtaatacgtagggtgcagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgtcgtagagatacggtttccctttgtggttggtgtacaggtggtgcatggttgtcgtcagctcgtgtcgtgagatgttgggttaagtcccgcaacgagcgcaacccttgtcttatgttgccagcacgttatggtggggactcgtgagagactgccggggttaactcggaggaaggtggggatgacgtcaaatcatcatgccccttatgtccagggcttcacacatgctacaatggtcggtacaacgcgcatgcgagcctgtgagggtgagcgaatcgctgtaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaaggtgcggctggatcacctcctttct

SEQ ID NO: 734 - DNA, 1436 bp, Corynebacterium variabile
gacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggaccatcgtttagtgtcggtggtggaaagtttttcggtgcaggatgagctcgcggcctatcagcttgttggtggggtaatggcctaccaaggcgtcgacgggtagccggcctgagagggtggacggccacattgggactgagacacggcccagactcctacgggaggcagcagtggggaatattgcacaattgggcgcaagcctgatgcagcgacgccgcgtgggggatgaaggccttcgggttgtaaactcctttcaaccatgacgaagcattatgtgacggtagtggtagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgccggatcgrcgcagagatgcgttttcccttgtggtcggtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgctacaccgtgaggtggtgctaatcccttaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgg

SEQ ID NO: 735 - DNA, 1362 bp, Corynebacterium xerosis
  modified_base (185)..(185): a, c, t, g, unknown or other
agtcgaacggtaaggccccagcttgctggggtacacgagtggcgaacgggtgagtaacacgtgggtgacctgccccgcacttcgggataagcctgggaaactgggtctaataccggataggaccgcaccgtgagggtgtggtggaaagtttttcggtgtgggatgggcccgcggcctatcagctngttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacgggaccgggccagagatggtccttcccttgtggctcgtatacaggtggtgcatggttgtcgtcagctcgtgtcgtgagatgttgggttaagtcccgcaacgagcgcaacccttgtcttatgttgccagcacgtaatggtggggactcgtgagaaactgccggggtcaactcggaggaaggtggggatgacgtcaaatcatcatgccccttatgtccagggcttcacacatgctacaatggtcggtacagtgggttgcgatgccgtgaggtggagctaatccctgaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggccc

SEQ ID NO: 736 - DNA, 1544 bp, Coxiella burnetii
tttaattgaagagtttgattctggctcagattgaacgctagcggcatgcttaacacatgcaagtcgaacggcagcgcggggagcttgctccctggcggcgagtggcggacgggtgagtaatgcgtaggaatctaccttgtagtgggggataacctggggaaactcgggctaataccgcataatctctttggagcaaagcgggggatcttcggacctcgtgctataagatgagcctacgtcggattagcttgttggtggggtaatggcctaccaaggcgacgatccgtagctggtctgagaggacgatcagccacactgggactgagacacggcccagactcctacgggaggcagcagtggggaatattggacaatgggggaaaccctgatccagcaatgccgcgtgtgtgaagaaggccttcgggttgtaaagcactttcggtggggaagaaattctcaagggtaatatccttgggcgttgacgttacccacagaagaagcactggctaactctgtgccagcagccgcggtaatacagagagtgcaagcgttaatcggaatcactgggcgtaaagcgcgcgtaggtggatatttaagtcggatgtgaaagccctgggcttaacctgggaattgcatccgatactgggtatcttgagtatggtagagggaagtggaatttccggtgtagcggtgaaatgcgtagatatcggaaagaacaccagtggcgaaggcgacttcctggaccaatactgacactgaggcgcgaaagcgtggggagcaaacaggattagagaccctggtagtccacgccgtcaacgatgagaactagctgttgggaagttcacttcttagtagcgaagctaacgcgttaagttctccgcctggggagtacggccgcaaggttaaaactcaaagaaattgacgggggcccgcacaagcggtggagcatgtggtttaattcgatgcaacgcgaaaaaccttacctacccttgacatcctcggaacttgtcagagatgatttggtgccttcgggaaccgagtgacaggtgctgcatggctgtcgtcagctcgtgtcgtgagatgttgggttaagtcccgtaacgagcgcaaccctcgtccttagttgccagcgagtcaagtcgggaactctaaggagactgccggtgataaaccggaggaaggtggggatgatgtcaagtcatcatggcccttacgggtagggctacacacgtgctacaatgggcagtacaaagggttgccaagccgcgaggtggagctaatcccagaaaactgctcgtagtccggattggagtctgcaactcgactccatgaagttggaatcgctagtaatcgcgaatcagcatgtcgcggtgaatacgttctcgggccttgtacacaccgcccgtcacaccatgggagtgaattgtaccagaagcgggtaggctaaccttcgggaggccgctcaccacggtatgatccatgactggggtgaagtcgtaacaaggtagccgtaggggaacctgcggctggatcacctccttact

SEQ ID NO: 737 - DNA, 1507 bp, Cronobacter malonaticus
agagtttgatcatggctcagattgaacgctggcggcaggcctaacacatgcaagtcgaacggtaacagagagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggattgtggttaataaccgcagtcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtaatggtgggaacccaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagccgta

SEQ ID NO: 738 - DNA, 1542 bp, Cronobacter sakazakii
aattgaagagtttgatcatggctcagattgaacgctggcggcaggcctaacacatgcaagtcgaacggtaacagggagtagcttgctgctctgctgacgagtggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgtggttaataaccacagcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 739 - DNA, 312 bp, Cronobacter turicensis
  modified_base (293)..(294): a, c, t, g, unknown or other
ctcaaaggagactgccggtgataaaccggaggaaggtggggatgacgtcaagtcatcatggcccttacgaccagggctacacacgtgctacaatggcagatacaaagagaagcgacctcgcgagagcaagcggaactcataaagtgtgtcgtagtccggattggagtctgcaactcgactccatgaagtcggaatcgctagtaatcgtagatcagaatgccacggtgaatacgttcccgggccttgtacacaccgcccgtcacaccatgggagtgggttgcaaaagaagtagnnagcttaaccttcgggagg

SEQ ID NO: 740 - DNA, 1448 bp, Cryptobacterium curtum
gagtttgatcctggctcaggatgaacgctggcggcgcgcctaacacatgcaagtcgaacgattaaaccgcccttgggcggatatacagtggcgaacgggtgagtaacgcgtgaccaaccttccccccgcatcgggacaacccggggaaacccgggctaataccggatatgccgggtatggcgcatgtcatacccaggaaagcttttgcggcgggggatggggtcgcgtcccatcaggtagacggcggggtagtagcccaccgtgccaacgacgggtagccgggttgagagaccgaccggccacattgggactgagatacggcccagactcctacgggaggcagcagtggggaatcttgcgcaatgggggaaaccctgacgcagcgacgccgcgtgcgggatggaggccttcgggccgtgaaccgctttcagcagggaagacattaaggacggtacctgcagaagaagccccggctaactacgtgccagcagccgcggtaatacgtagggggcgagcgttatccggattcattgggcgtaaagcgcgcgcaggcggcgcaccaggcgggatctcgaaaccgggggctcaacctccgggcggatcccgaaccggtgtgctcgagtgcggtagaggaagtcggaattcccggtgtagcggtgaaatgcgcagatatcgggaagaacaccgatggcgaaggcagacttctgggccgacactgacgctcaggcgcgaaagctgggggagcgaacaggattagataccctggtagtcccagccgtaaacgatgggcactaggtgtggggggcatttgccttccgtgccgcagctaacgcattaagtgccccgcctggggagtacggccgcaaggctaaaactcaaaggaattgacgggggcccgcacaagcagcggagcatgtggcttaattcgaagcaacgcgaagaaccttaccagggcttgacatgtaggtgaagcgacagagatgtcgcagccgaaaggagcctacacaggtggtgcatggctgtcgtcagctcgtgtcgtgagatgttgggttaagtcccgcaacgagcgcaacccctgccgcatgttgccagcatttagttggggactcatgcgggaccgccggcggcaagccggaggaaggcggggacgacgtcaagtcatcatgccccttatgccctgggctgcacacgtgctacaatggccggcacaacgggatgcaaaggcgcgagcccaagcggatcccccaaagccggtcccagttcggatcggaggctgcaacccgcctccgtgaagccggagttgctagtaatcgcggatcagcatgccgcggtgaatacgttcccgggccttgtacacaccgcccgtcacaccacccgagtcgtctgcacccgaagtcgccggccgaacccttttgggacggaggcgccgaaggcgcgggggataaggg

SEQ ID NO: 741 - DNA, 1400 bp, Cupriavidus metallidurans
catgcaagtcgaacggcagcgcggacttcggtctggcggcgagtggcgaacgggtgagtaatacatcggaacgtaccctgttgtgggggataactagtcgaaagattagctaataccgcatacgacctgagggtgaaagtgggggaccgcaaggcctcacgcagcaggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcgcgctggttaatacctggcgtggatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgggcttaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcattttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgat

SEQ ID NO: 742 - DNA, 1507 bp, Cytophaga xylanolytica
gtttgatcctggctcaggatgaacgctagcgacaggcctaacacatgcaagtcgaggggcagcacgtcttcggatggtggcgaccggcgcacgggtgagtaacgcgtatgtaacctgcctacaacagggggatagctcgctgaaaagcgaattaagaccgcataagaccacgctttcgcatgttagcgtggtaaaatatttataggttgtagatgggcatgcgtgacattagctagttggtaaggtaacggcttaccaaggcaacgatgtctaggggttctgagaggaaggtcccccacactggtactgagacacggaccagactcctacgggaggcagcagtgaggaatattggtcaatgggcgagagcctgaaccagccatgtcgcgtgcaggatgacggccctacgggttgtaaactgcttttgtacgggaagaaaaaacgccacgtgtggtgtcttgccggtaccgtacgaataaggatcggctaactccgtgccagcagccgcggtaatacggaggatccgagcgttatccggatttattgggtttaaagggtgcgtaggcgggagattaagtcagtggtgaaagtttgcggctcaaccgtaaaattgccattgatactggttttcttgagtacagttgaggtaggcggaatgtggtgtgtagcggtgaaatgcttagatataccacagaacaccgattgcgaaggcagcttactaaagtgtaactgacgctgatgcacgaaagcgtggggatcaaacaggattagataccctggtagtccacgcagtaaacgatgatcactcgttgtttgcgatacattgcaagtgaccaagagaaatcgataagtgatccacctggggagtacggccgcaaggctgaaactcaaaggaattgacgggggcccgcacaagcggaggaacatgtggtttaattcgatgatacgcgaggaaccttacctgggtttaaatggggagtgacagctgccgaaaggtggtcttcttcggacactcttcaaggtgctgcatggttgtcgtcagctcgtgccgtgaggtgtcgggttaagtcccataacgagcgcaacccacgtcgttagttgccatcaggtsatgctgggcactctaacgagactgccggtgtaaaccgcgaggaaggtgtggatgacgtcaaatcagcacggcccttacatccagggctacacacgtgttacaatggccggtacagagggctgctaccatgcgaatggatgctaatcctaaaaaccggtcccagttcggattggagtctgcaacccgactccatgaagctggattcgctagtaatcgcgcatcagccatggcgcggtgaatacgttcccgggccttgtacacaccgcccgtcaagccatggaagctgagggtacctaaagtctgtcaccgtaaggagcggcctagggtaaaattggtaactggggctaagtcgtaacaaggtagccgtaccggaaggtgcggctggatcacctcctt

SEQ ID NO: 743 - DNA, 1325 bp, Deferribacteres sp. oral clone JV001
ggagtttgatcctggctcaggatgaacgctggcggcgtgcgtaacacatgcaagttgaacgagtagcggacgggtgagtacaacatgagaagctgtccttcagcggggggcaacgtctggaagcggacgctaataccccatagtaaaggcgcgacgggaggtactcgtgtcctatcagctagttggtgaggtaacggctcaccaaggcgacgacgggtagccggcctgagagggtgaccggccacactggaactgagatacggtccagactcctacgggaggcagcagtggggaatattgggcaatgggaggaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggctgtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgccagcggccgggcactctaatgggactgccatcgacaagatggaggaaggtggggatgacgtcaagtcatcatggcccttatgtccagggcgacacacgtgctacaatggccggcagagggaagcgaggctgtgaggttgagcggatcccctccggtctcagttcggatgaagtctgcaattcgacttcagaagctggaatcgctagtaatcgcagatcagccaagctgcggtgaatacgttcccgggccttgtacacaccgcccgtcacaccacccgagccgggtgtacccgaagccggtgcctaaggagccgtcgaaggtgtgtctggtgaggggggtgaagtcgtaac

SEQ ID NO: 744 - DNA, 1325 bp, Deferribacteres sp. oral clone JV006
ggagtttgatcatggctcaggatgaacgctggcggcgtgcgtaacacatgcaagttgaacgagtagcggacgggtgagtaaagcatgagaatctgtcctgtcgagggggataacgttcggaaacggaccctaataccccatagtaaaggcgcggcaggaggagctcgtgtcctatcagctagttggtgaggtaacggctcaccaaggcttcgacgggtagccggcctgagagggtgaccggccacactggaactgagacacggtccagactcctacgggaggcagcagtggggaatattgggcaatgggagaaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggccgtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgccagcgatcgggcactctaatgggactgccatcgacaagatggaggaaggtggggatgacgtcaagtcatcatggcccttatgtccagggcgacacacgtgctacaatggccggcagagggaagcgacactgcgaggtgaagcggatcccatccgctctcagttcggatgaagtctgcaattcgacttcagaagttggaatcgctagtaatcgcagatcaaccaagctgcggtgaatccgtccccgggccttgtacacaccgcccgtcacaccacccgagccgggtgtacccgaggccggtgcctaaggagccgtcgaaggtgtgtctggtgaggggggtgaagtcgtaac

SEQ ID NO: 745 - DNA, 1325 bp, Deferribacteres sp. oral clone JV023
ggagtttgatcctggctcaggatgaacgctggcggcgtgcgtaacacatgcaagttgaacgagtagcggacgggtgagtaaagcatgagaatctgtcctgccgagggggataacgttcggaaacggaccctaataccccatagtaaaggcgcggcaggaggagctcgtgtcctatcagctggttggtgaggtaagggctcaccaaggcttcgacgggtagccggcctgagagggtgaccggccacactggaactgagagacggtccagactcctacgggaggcagcagtggggaatattgggcaatgggaggaatcctgacccagcgacgccgcgtgaacgaagacggccttcgggttgtaaagttcttttatgtgggaagatgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggagtaccggagaggcaagtggaattcccagtgtagcggtgaaatgcgtagatattgggaagaacatcggtggcgaaggcgacttgctggacggactgacgctgaggtgcgaaagccagggtagcgaacgggattagataccccggtagtcctggcggtaaacgatgaatgctaggtgtgcgagttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgcacaggtgctgcatggctgtcgtcagctcgtgtcgtgagatgttgggttaagtcccgcaacgagcgcaacccctgcgattagttgctaacggccgagcactctaatgggactgccatcgacaagatggaggaaggtggggatgacgtcaagtcatcatggcccttatgtccagggcgacacacgtgctacaatggccggcagagggaagcgaggctgtgaggttgagcggatcccctccggtcacagttcggatgaagtctgcaattcgacttcagaagctggaatcgctagtaatcgcagatcagccaagctgcggtgaatacgttcccgggccttgtacacaccgcccgtcacaccacccgagccgggtgtacccgaagccggtgcctaaggagccgtcgaaggtgtgtctggtgaggggggtgaagtcgtaac

SEQ ID NO: 746 - DNA, 1502 bp, Deinococcus radiodurans
tttatggagagtttgatcctggctcagggtgaacgctggcggcgtgcttaagacatgcaagtcgaacgcggtcttcggaccgagtggcgcacgggtgagtaacacgtaactgacctacccagaagtcacgaataactggccgaaaggtccgctaatacgtgatgtggtgatgcaccgtggtgcatcactaaagatttatcgcttctggatggggttgcgttccatcagctggttggtggggtaaaggcctaccaaggcgacgacggatagccggcctgagagggtggccggccacaggggcactgagacacgggtcccactcctacgggaggcagcagttaggaatcttccacaatgggcgcaagcctgatggagcgacgccgcgtgagggatgaaggttttcggatcgtaaacctctgaatctgggacgaaagagccttagggcagatgacggtaccagagtaatagcaccggctaactccgtgccagcagccgcggtaatacggagggtgcaagcgttacccggaatcactgggcgtaaagggcgtgtaggcggaaatttaagtctggttttaaagaccggggctcaacctcggggatggactggatactggatttcttgacctctggagaggtaactggaattcctggtgtagcggtggaatgcgtagataccaggaggaacaccaatggcgaaggcaagttactggacagaaggtgacgctgaggcgcgaaagtgtggggagcaaaccggattagatacccgggtagtccacaccctaaacgatgtacgttggctaagcgcaggatgctgtgcttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgctaggaactttgcagagatgcagaggtgcccttcggggaacctagacacaggtgctgcatggctgtcgtcagctcgtgtcgtgagatgttgggttaagtcccgcaacgagcgcaacccttgcctttagttgtcagcattcagttggacactctagagggactgcctatgaaagtaggaggaaggcggggatgacgtctagtcagcatggtccttacgtcctgggcgacacacgtgctacaatgggtaggacaacgcgcagcaaacccgcgagggtaagcgaatcgctaaaacctatccccagttcagatcggagtctgcaactcgactccgtgaagttggaatcgctagtaatcgcgggtcagcataccgcggtgaatacgttcccgggccttgtacacaccgcccgtcacaccatgggagtagattgcagttgaaaccgccgggagcttaacggcaggcgtctagactgtggtttatgactggggtgaagtcgtaacaaggtaactgtaccggaaggtgcggttggatcacctccttt

SEQ ID NO: 747 - DNA, 1333 bp, Deinococcus sp. R-43890
ggtgaacgctggcggcgtgcttaagacatgcaagtcgaacgagatcttcggatctagtggcgcacgggtgagtatcgcgtgactgacctgccccaaagttccgaataactggctgaaaggtcagctaatacggaatgtgcagcatcctcgtgtggatgttgtaaaggctatgaccgctttgggatggggttgcgttccatcagctagttggtggggtaaaggcccaccaaggcgacgacggataaccggcctgagagggtggccggtcacaggggcactgagacacgggtcccactcctacgggaggcagcagttaggaatcttccccaatggacgaaagtctgagggagcgacgccgcgtgagggatgaaggttttcggatcgtaaacctctgaatctgggacgaaagaccgggacaaccggagatgacggtaccagagtaatagcaccggctaactccgtgccagcagccgcggtaatacggagggtgcaagcgttacccggaatcactgggcgtaaagggcgtgtaggcggcatcacaagtctggttttaaagcctgcggctcaaccgcagagatggactggagactgtgaagctagacctctggagagagaactggaattcctggtgtagcggtggaatgcgtagataccaggaggaacaccgatggcgaaggcaggttcttggacagaaggtgacgctgaggcgcgaaagtgtggggagcaaaccggattagatacccgggtagtccacaccctaaacgatgtacgttggcctacagcaggatgctgttgtgggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatccatagaagctcccggagacgggagcgtgcccttcggggagctatgagacaggtgctgcatggctgtcgtcagctcgtgtcgtgagatgttgggttaagtcccgcaacgagcgcaacccctaccttcagttgccagcattcagttgggcactctgacgggactgcctatgaaagtaggaggaaggcggggatgacgtctagtcagcatggtccttacgacctgggctacacacgtgctacaatggatggtacaacgcgcagccaactcgcgagagtgagcgaatcgccaaaagccatccccagttcagatcggagtctgcaactcgactccgtgaagttggaatcgctagtaatcrcgggtcagcataccgsgrtgaatacgttcccgggcct

SEQ ID NO: 748 - DNA, 1526 bp, Delftia acidovorans
agagtttgatcctggctcagattgaacgctggcggcatgccttacacatgcaagtcgaacggtaacaggtcttcggacgctgacgagtggcgaacgggtgagtaatacatcggaacgtgcccagtcgtgggggataactactcgaaagagtagctaataccgcatacgatctgaggatgaaagcgggggaccttcgggcctcgcgcgattggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagcaatgccgcgtgcaggatgaaggccttcgggttgtaaactgcttttgtacggaacgaaaaagcttctcctaatacgagaggcccatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggaattagttttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgaaagagaacctgcacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagcatgccgcggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctccttt

SEQ ID NO: 749 - DNA, 1394 bp, Dermabacter hominis
catgcaagtcgaacgatgaagctgtgcttgcacagtggattagtggcgaacgggtgagtaacacgtgagtaacctgcccttcactttgggataactccgagaaatcggggctaataccggatatgactactggccgcatggttggtggtggaaagtttttcggtgagggatgggctcgcggcctatcagtttgttggtgaggtagtggctcaccaaggcgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacctctttcagcaaggaagaagcgaaagtgacggtacttgcagaagaagcgccggctaactacgtgccagcagccgcggtaatacgtagggcgcaagcgttgtccggaattattgggcgtaaagagcttgtaggtggcttgtcgcgtctgccgtgaaaacccgaggcttaaccttgggcgtgcggtgggtacgggcaggctagagtgcggtaggggagactggaattcctggtgtagcggtgaaatgcgcagatatcaggaggaacaccgatggcgaaggcaggtctctgggccgttactgacactgagaagcgaaagcatggggagcgaacaggattagataccctggtagtccatgccgtaaacgttgggcactaggtgtggggagcattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggatcgctgcagagatgtggttttctttggactggtgcacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggacgacgtcaaatcatcatgccccttatgtcttgggcttcacgcgtgctacaatggtcggtacaatgggttgcgatactgtgaggtggagctaatcccaaaaagccggtctcagttcggattggggtctgcaactcgaccctatgaagtcggagtcgctagtaatcgcagatcagcaatgctgcggtgaatacgttcccgggccttgtacacaccgcccgtcaagtcacgaaagtcggtaacacccgaagccgatggcccaagcttttgcggggagtcgtcgaaggt

SEQ ID NO: 750 - DNA, 1520 bp, Dermacoccus sp. Ellin185
  modified_base (434)..(435): a, c, t, g, unknown or other
tttctacggagagtttgatcctggctcaggacgaacgctggcggcgtgcttaacacatgcaagtcgaacgatgaagcaccagcttgctggtgtggattagtggcgaacgggtgagtaacacgtgagtaacctgcccctcactctgggataagcctgggaaactgggtctaatactggatacgaccgatctccgcatggagtgttggtggaaagtttttgtggtgggggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaannttcaccagggacgaagctaacgtgacggtacctggagaagaagcaccggctaactacgtgccagcagccgcggtaatacgtagggtgcggcgttgtccggaattattgggcgtaaagagcttgtaggcggtctgtcgcgtctgctgtgaaagaccggggcttaactccggttctgcagtgggtacgggcagactagagtgtggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatcatgcagagatgtgtgcgtcttcggactggtgtacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggatgacgtcaaatcatcatgccccttatgtcttgggcttcacgcatgctacaatggccggtacagagggttgcgaaaccgtgaggtggagctaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggggggagccgtcgaaggtgggactggcgattgggactaagtcgtaacaaggtagccgtaccggaaggtgcggctggatcacctccttt

SEQ ID NO: 751 - DNA, 1522 bp, Desmospora activa
gctggcggcgtgcctaatacatgcaagtcgagcggaccgatggagagcttgctctcttgaagtcagcggcgaacgggtgagtaacacgtgggcaacctgcccgcaagactgggataactccgggaaaccggggctaataccggatacgatcttccctcgcatgagagaagatggaaaggcggcatcacgctgtcacttgcggatgggcccgcggcgcattagctagttggtgaggtagtggctcaccaaggcgacgatgcgtagccgacctgagagggtgaccggccacactgggactgagacacggcccagactcctacgggaggcagcagtagggaattttcgtcaatgggcgcaagcctgaacgagcaacgccgcgtgagtgaggacggctttcgggttgtaaagctctgttcttcgggaagaacgacagaagggtgaataatccttttgtgtgacggtaccggagaagaaagccccggctaactacgtgccagcagccgcggtaatacgtagggggcaagcgttgtccggaattattgggcgtaaagcgcgcgcaggcggcctgttaagtcggatgtgaaagaccacggctcaaccgtgggggtgcatccgaaactggcgggcttgagtgcaggagaggggagtggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccccttcagagatgaaggttcccttcggggcagcggagacaggtggtgcatggttgtcgtcagctcgtgtcgtgagatgttgggttcagtcccgcaacgagcgcaacccttatcgttagttgccagcacctcgggtgggcactctagcgagacagccggtgaaagccggaggaaggtggggatgaggtcaaatcatcatgccccttatgtcctgggcaacacacgtgctacaatggctggtacaacgggtcgcgaagccgcgaggtggagccaatcccaaaaaaccagtctcagttcggatcgcaggctgcaactcgcctgcgtgaagctggaatcgctagtaatcgcggatcagcatgccgcggtgaatacgttcccgggccttgtacacaccgcccgtcacaccacgagagtttgcaacacccgaagtcggtgagggaacccttttgggacccagccgccgaaggtggggcagatgattggggtgaagtcgtaacaaggtatccctaccggaaggtggggctggatcacctcctttcta

SEQ ID NO: 752 - DNA, 1455 bp, Desmospora sp. 8437
agcggcggacgggtgagtaacacgtgggcaacctgcccgcaagaccgggataactccgggaaaccggggctaataccggatgatgcctcttcctgcatgggaggatgctgaaaggcggcctttggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgcaagcctgacggagcaacgccgcgtgagtgaggacggctttcgggttgtaaaactctgttcttcgggaagaacggtcgaagggtgaacaatcctttggcgtgacggtaccggaggagaaagccccggctaactacgtgccagcagccgcggtaatacgtagggggcaagcgttgtccggaattattgggcgtaaagcgcgcgcaggcggcctgttaagtctggtgtgaaagaccacggctcaaccgtggggtggcatcagaaactggcgggcttgagtgcaggagaggagagtggaattcccggtgtagcggtggaatgcgtagagatcgggaggaacaccagtggcgaaggcgactctctggcctgtaactgacgctgaggcgcgaaagcgtggggagcgaacaggattagataccctggtagtccacgccgtaaacgatgagtgctaggtgttgggggtttccgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgtagagatacaccttcccttcggggcagcggtgacaggtggtgcatggttgtcgtcagctcgtgtcgtgagatgttgggttcagtcccgcaacgagcgcaacccttgtcgtcagttgccagcacatgatggtgggcactctggcgagacagccggtgaaagccggaggaaggtggggatgacgtcaaatcatcatgccccttatgtcctgggctacacacgtgctacaatggccggtacaacgggcagcgaacccgtgagggggagccaatcccaaaaaaccggtctcagttcggatcgcaggctgcaactcgcctgcgtgaagctggaatcgctagtaatcgcggatcagcatgccgcggtgaatccgttcccgggccttgtacacaccgcccgtcacaccacgagagtctgcaacacccgaagtcggtgaggtaaccttcgggaaccagccgccgaaggtggggcagatgattggggtgaagtcgtaacaaggtatccctaccggaaggtggggatggatcacctcctttct

SEQ ID NO: 753 - DNA, 1456 bp, Desulfitobacterium frappieri
  modified_base (968)..(968): a, c, t, g, unknown or other
cactgagtgctaaacgttagttagtggcggacgggtgagtaacgcgtggataacctacctagtagaccgggacaacccttggaaacgagggctaataccggatgagcttaattagtggcatcactgattaaggaaagatggcctctgaagatgctatcgttagtagatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtaagtatgtaaataatgtacttacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcctgtggaaacatgggagtgnccttcggggagctatgagacaggtggtgcatggttgtcgtcagctcgtgtcgtgagatgttgggttaagtcccgcaacgagcgcaacccctatgtttagttgctaacgcgtaatggtgagcactctagacagactgccggtgacaaaccggaggaaggtggggatgacgtcaaatcatcatgccccttatgtcttgggctacacacgtgctacaatggccagtacagacggaagcgaagccgtgaggtgaagccaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgatgattggggtgaagtcgtaacaaggtatcc

SEQ ID NO: 754 - DNA, 1554 bp, Desulfitobacterium hafniense
agagtttgatcctggctcaggacgaacgctggcggcgtgcctaacacatgcaagtcgaacggagagctcaataagcttgcttagagagttcttagtggcggacgggtgagtaacgcgtggataacctacctagtagaccgggacaacccttggaaacgagggctaataccggataagcttaattagtggcatcactgattaaggaaagatggcctctgaagatgctatcgttagtagatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtaagtatgtaaagaatgtacttacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcctgtggaaacatgggagtgcccttcggggagctatgagacaggtggtgcatggttgtcgtcagctcgtgtcgtgagatgttgggttaagtcccgcaacgagcgcaacccctatgtttagttgctaacgcgtaatggtgagcactctagacagactgccggtgacaaaccggaggaaggtggggatgacgtcaaatcatcatgccccttatgtcttgggctacacacgtgctacaatggccagtacagacggaagcgaagccgtgaggtgaagccaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgatgattggggtgaagtcgtaacaaggtagccgtatcggaaggtgcggctggatcacct

SEQ ID NO: 755 - DNA, 1557 bp, Desulfobulbus sp. oral clone CH031
gagagtttgatyctggctcagaacgaacgctggcggcgtgcttaacacatgcaagtcgaacgcgaacgggacttcggttcctagtagagtggcgcacgggtgagtaacgcgtagataacctgtcttcatatccggaataacacgccgaaaggggtactaataccggatgttcttgcatttcacaggtaaggcaaggaaaggtggcctctgattcaagctactgtatgaagaggggtctgcgtaccattagctagtaggtggggtaatggcctacctaggcgacgatggttagcgggtctgagaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgcaaggcagcgaataactgttttgtttgacggtacctctaaaggaagcaccggctaactccgtgccagcagccgcggtaatacggagggtgcgagcgttgttcggaatcactgggcgtagagggcgcgcaggcgggctgtcaagtcagatgtgaaatcccacggcttaactgtggacgtgcatttgaaactggcagtcttgagtaccagaggggaatgtggaattcccggtgtagaggtgaaattcgtagatatcgggaggaataccggtggcgaaggcgacattctggctggatactgacgctgaggcgcgaaagcgtggggagcaaacaggattagataccctggtagtccacgccgtaaacgatgtgaactagatgcagggggtgttgatcccctctgtgtcgcggctaacgcattaagttcaccgcctggggagtacggtcgcaagattaaaactcaaaggaattgacgggggcccgcacaagcggtggggtatgtggtttaattcgatgcaacgcgaagaaccttacctggtcttgacatcccggagacgcccatgaaagtgggtggtgccttctttgaaggaatccggagacaggtgctgcatggctgtcgtcagctcgtgtcgtgagatgttgggttaagtcccgcaacgagcgcaacccttgccttcagttgccagcggttcggccgggcactctgaagggactgccggtgtcaaaccggaggaaggtggggatgacgtcaagtcctcatggcccttatgaccagggctacacacgtactacaatggccggtacaaaggggagcgacattgcgaaatggagccaatcccgcaaagccggtctcagtccggattggagtctgcaactcgactccatgaagttggaatcgctagtaatcgtggatcagcatgccacggtgaatacgttcccgggccttgtacacaccgcccgtcacaccacgggagtcggttgtaccagaagcagttgagctaaccgcaagggggcaggctgccaaggtacggctggtaactggggtgaagtcgtaacagggtagccctaggggaacctggggctggatcacctccttaagggc

SEQ ID NO: 756 - DNA, 1431 bp, Desulfotomaculum nigrificans
  modified_base (1)..(1): a, c, t, g, unknown or other
  modified_base (43)..(46): a, c, t, g, unknown or other
  modified_base (66)..(66): a, c, t, g, unknown or other
  modified_base (186)..(186): a, c, t, g, unknown or other
  modified_base (415)..(415): a, c, t, g, unknown or other
  modified_base (419)..(419): a, c, t, g, unknown or other
  modified_base (615)..(615): a, c, t, g, unknown or other
  modified_base (619)..(619): a, c, t, g, unknown or other
  modified_base (891)..(891): a, c, t, g, unknown or other
  modified_base (897)..(897): a, c, t, g, unknown or other
  modified_base (906)..(906): a, c, t, g, unknown or other
  modified_base (1420)..(1420): a, c, t, g, unknown or other
natagtttgatcctggctcaggacgaacgctggcggcgtgccnnnnacatgcaagtcgaacggggntgaatgaagcttggcgatttctaaacctagtggcggacgggtgagtaacgcgtggataacctgcctggtagaccgggataacagctggaaacggctgctaataccggatacgctcttggngccgcatggtgccgagaggaaaggggagccgctatcagatggatccgcgtcccattagctggttggtggtgtagcggaccaccaaggcgacgatgggtagccggcctgagagggcgaccggccacactgggactgagacacggcccagactcctacgggaggcagcagtggggaatcttccgcaatgggcgaaagctgacggagcaacgccgcgtgagggaagaaggcntcgngttgtaaacctctgtcctaaaggaagaaagaaatgacggtactttaggaagaatgacggtactttaggaggaagccccggctaactacgtgccagcagccgcggtaaaacgtagggggcgagcgttgtccggaattactgggcgtaaagggcgcgtaggtggtccattaagttagaggtgaaagtgcggggcttancccngtgattgcctctgatactggtggacttgagtgcaggagaggggagcggaattcccagtgtagcggtgaaatgcgtagatattgggaggaacaccagtggcgaaggcggctctctggactgcaactgacactgaggcgcgaaagcgtggggagcaaacaggattagataccctggtagtccacgccgtaaacgatgagtgctaggtgttgcgggtatcgacccctgcagtgccgcagtaaacacaataagcactccgcctggggagtacggtngcaagnctgaaactnaaaggaattgacggggccccgcacaagcggtggagtatgtggtttaattcgacgcaacgcgaagaaccttaccagggcttgacatcccgcgcaccactctagagatagagggttctgccttagggtagacgcgcagacaggtggtgcatggttgtcgtcagctcgtgtcgtgagatgttgggttaagtcccgcaacgcgcgcaacccctaacattagttgccagcgatagagacggggactctaatgtgactgccgttgacaaaacggaggaaggtggggatgacgtcaaatcatcatgccccttatgtcctgggctacacacgtactacaatggccggtactaacggatgcgaatggcgtgagccggagcaaaactgagaaagccggtctcagttcggattgtagtctgcaactcgactacatgaagtcggaatcgctagtaatcgcaggtcagcatactgcggtgaatacgttcccgggccttgtacacaccgcccgtcacaccacgaaagntgacaacaccc

SEQ ID NO: 757 - DNA, 1548 bp, Desulfovibrio desulfuricans
attagagtttgatcctggctcagattgaacgctggcggcgtgcttaacacatgcaagtcgaacgcgaaagggacttcggtcctgagtaaagtggcgcacgggtgagtaacgcgtggataatctgcccttatgatcgggataacagttggaaacggctgctaataccggatacgctcaaaatgaactttttgaggaaagatggcctctgcttgtatgctatcacgtaaggatgagtccgcgtcccattagcttgttggcggggtaacggcccaccaaggcatcgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaactacgttgtgctaatcagcagcgtactgacggtaccttcaaaggaagcaccggctaactccgtgccagcagccgcggtaatacggagggtgcaagcgttaatcggaattactgggcgtaaagcgcacgtaggctgtagtgtaagtcaggggtgaaatcccacggctcaaccgtggaactgcctttgatactgcacaacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccacggaaccctcccgaaaaggaggggtgcccttcggggagccgtgagacaggtgctgcatggctgtcgtcagctcgtgtcgtgagatgttgggttaagtcccgcaacgagcgcaacccctatggatagttgccagcaagtaatgttgggcactctattcagactgcccgggttaaccgggaggaaggtggggacgacgtcaagtcatcatggcccttacgcctagggctacacacgtactacaatggcgcgcacaaaggggagcgagaccgcgaggtggagccaatcccaaaaaacgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgaagccggtgagccaaccagcaatggaggcagccgtctacggtagggccgatgattggggtgaagtcgtaacaaggtagccgtaggggaacctgcggctggatcacctccttaat

SEQ ID NO: 758 - DNA, 1394 bp, Desulfovibrio fairfieldensis
tcgaacgcgaaagagacttcggtctcgagtagagtggcgcacgggtgagtaacgcgtggataatctgccctcatgaccgggataacagttggaaacggctgctaataccggatacgctctgaatgaacttttaggggaaagacggcctctgcttgcaagctgtcgtatgaggatgagtccgcgtcccattagctagttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaacc

SEQ ID NO: 759 - DNA, 1053 bp, Desulfovibrio piger
  modified_base (44)..(44): a, c, t, g, unknown or other
  modified_base (49)..(50): a, c, t, g, unknown or other
  modified_base (699)..(699): a, c, t, g, unknown or other
  modified_base (713)..(713): a, c, t, g, unknown or other
  modified_base (861)..(861): a, c, t, g, unknown or other
  modified_base (893)..(894): a, c, t, g, unknown or other
  modified_base (941)..(942): a, c, t, g, unknown or other
  modified_base (959)..(960): a, c, t, g, unknown or other
  modified_base (965)..(965): a, c, t, g, unknown or other
  modified_base (974)..(974): a, c, t, g, unknown or other
  modified_base (979)..(980): a, c, t, g, unknown or other
  modified_base (1009)..(1010): a, c, t, g, unknown or other
  modified_base (1018)..(1019): a, c, t, g, unknown or other
  modified_base (1023)..(1023): a, c, t, g, unknown or other
  modified_base (1030)..(1030): a, c, t, g, unknown or other
  modified_base (1042)..(1042): a, c, t, g, unknown or other
cgcgaagggacttcggtcccgagtaaagtggcgcacgggtgagnaacanntggataatctgcctctatgatggggataacagttggaaacgactgctaataccgaatacgctcatgatgaactttgtgaggaaaggtggcctctgcttgcaagctatcgcatagagatgagtccgcgtcccattagctagttggtggggtaacggcctaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggtcttcggatcgtaaacctctgtcagaagggaagaaactagggtgctctaatcatcatcctactgacggtaccttcaaaggaagcaccggctaactccgtgccagcagccgcggtaatacggagggtgcaagcgttaatcggaatcactgggcgtaaagcgcacgtaggctgttatgtaagtcaggggtgaaatcccacggctcaaccgtggaactgcccttgatactgcacgacttgaatccgggagagggtggcggaattccaggtgtaggagtgaaatccgtagatatctggaggaacatcagtggcgaaggcggccacctggaccggtattgacgctgangtgcgaaagcgtgnggagcaaacaggattagataccctggtagtccacgccgtaaacgatggatgctggatgtcgggatgtatgtctcggtgtcgtagttaacgcgttaagcatcccgcctggggagtacggtcgcaaggctgaaactcaaagaaattgacnggggcccgcacaagcggtggagtatgtggttnnattcgatgcaacgcgaagaaccttacctaggtttgacatctgggganncctcccgaaaaggaggnntgccnttcgggganccccnnacaggtgctgcatggctgtcgtcagctcnngtcgtganntgtnggttaantcccgcaacgancgcacccctat

SEQ ID NO: 760 - DNA, 1027 bp, Desulfovibrio sp. 3_1_syn3
  modified_base (8)..(8): a, c, t, g, unknown or other
  modified_base (12)..(15): a, c, t, g, unknown or other
  modified_base (21)..(21): a, c, t, g, unknown or other
ggatcgtnaacnnnntcagangggaagaaagtgcgtggtgctaatcagccgcgcattgacggtaccttcaaaggaagcaccgggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaacc

SEQ ID NO: 761 - DNA, 1542 bp, Desulfovibrio vulgaris
agagtttgattctggctcagattgaacgctggcggcgtgcttaacacatgcaagtcgcgcgtgaaaggacttcggtccgagtaaagcggcgcacgggtgagtaacgcgtggatgatctacccatgagttaggaataacggctggaaacggtcgctaataccaaatacgctccgatttcaacttcgggggaaaggtggcctctgcttgcaagctactgctcatggatgagtccgcgtcccattagctagttggtggggtaacggcccaccaaggcgacgatgggtagccggtctgagaggatgaccggccacactgggactggaacacggcccagactcctacgggaggcagcagtggggaatattgcgcaatgggcgaaagcctgacgcagcgacgccgcgtgagggatgaaggtcctcggatcgtaaacctctgtcaggagggaagaaccgccacggtgctaatcagccgtggtctgacggtacctccaaaggaagcaccggctaactccgtgccagcagccgcggtaatacggagggtgcgagcgttaatcggaatcactgggcgtaaagcgcacgtaggctgcttggtaagtcaggggtgaaagcccgcggctcaaccgcggaattgcctttgatactgccgagctagagtccgggagagggtagtggaattccaggtgtaggagtgaaatccgtagagatctggaggaacatcagtggcgaaggcgactacctggaccggtactgacgctgaggtgcgaaagcgtggggagcaaacaggattagataccctggtagtccacgccgtaaacgatggatgctaggtgtcggggccttgagcttcggtgccgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccggaagaccttcccgaaaaggaagggtgcccttcggggaattccgagacaggtgctgcatggctgtcgtcagctcgtgccgtgaggtgttgggttaagtcccgcaacgagcgcaacccctattgccagttgctaccaggtaatgctgggcactctggtgagactgccccggttaacggggaggaaggtggggacgacgtcaagtcatcatggcccttacgcctagggctacacacgtactacaatggcgcatacaaagggcagcgataccgcgaggtggagccaatcccaaaaagtgcgtcccagtccggattgcagtctgcaactcgactgcatgaagttggaatcgctagtaattcgagatcagcatgctcgggtgaatgcgttcccgggccttgtacacaccgcccgtcacaccacgaaagttggttttacccgacaccggtgagctaaccagcaatggaggcagccgtctacggtagggccgatgattggggtgaagtcgtaacaaggtagccgtaggggaacctgcggctggatcacctccttt

SEQ ID NO: 762 - DNA, 965 bp, Dialister invisus
  modified_base (9)..(10): a, c, t, g, unknown or other
  modified_base (12)..(12): a, c, t, g, unknown or other
  modified_base (16)..(17): a, c, t, g, unknown or other
  modified_base (20)..(22): a, c, t, g, unknown or other
  modified_base (43)..(49): a, c, t, g, unknown or other
  modified_base (700)..(700): a, c, t, g, unknown or other
  modified_base (716)..(716): a, c, t, g, unknown or other
  modified_base (785)..(785): a, c, t, g, unknown or other
  modified_base (940)..(940): a, c, t, g, unknown or other
  modified_base (944)..(944): a, c, t, g, unknown or other
  modified_base (954)..(954): a, c, t, g, unknown or other
gaaaagacnnanagannttnnncttttcagaattgagtggcannnnnnngagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacnaaaaactgacgctgangcgcgaaagcgtggggagcaaacaggattagataccctggtagtccacgccgtaaacgatggatactangtgtaggaggtatcgacccctcctgtgccggagttaacgcaataagtatcccgcctgggaaagtacgatcgcaagattaaaactcaaaggaattgacgggggcccgcacaagcggtggagtatgtggtttaattcgacgcaacgcgaagaacctnaccnggtcttgacnttgatcgcgat

SEQ ID NO: 763 - DNA, 1565 bp, Dialister micraerophilus
tggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggggctgatgattggagtgaagtcgtaacaaggtagccgtatcggaaggtgcggctggatcacctcctttct

SEQ ID NO: 764 - DNA, 1328 bp, Dialister microaerophilus
tggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagat

SEQ ID NO: 765 - DNA, 1547 bp, Dialister pneumosintes
gagtttgatcctggctcaggacgaacgctggcggcgtgcttaacacatgcaagtcgaacggaaagagatgaaagagcttgctcttttattaatttcagtggcaaacgggtgagtaacacgtaaacaacctgccttaaggatggggataacagacggaaacgactgctaataccgaatacgttctaagcatcgcatggtgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtttgtggtgaataatcatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcaacgagcgcaacccctatttcctgttaccagcacgtaaaggtggggactcaggagagaccgccgcggacaacgcggaggaaggcggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaatacgttcccgggccttgtacacaccgcccgtcacactatgagagttagagacacccgaagccggtgaggtaaccgcaagggaccagccgtctaaggtggagctgatgattggagtgaagtcgtaacaaggtagccgtatcggaaggtgcgg

SEQ ID NO: 766 - DNA, 1396 bp, Dialister propionicifaciens
aaaagactgctcttttcgatccagtggcaaacgggtgagtaacacgtaaacaacctgccttcaggatggggacaacagacggaaacgactgctaataccgaatacgttccacgggccgcatgacctgtggaagaaagggtagcctctacctgtaagctatcgcctgaagaggggtttgcgtctgattaggcagttggtggggtaacggcccaccaaaccaacgatcagtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgatccgggacgaaagagcctgaggttaatagcctaaggaagtgacggtaccggaaaagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcaattttcagaaatgagaagttctccttcgggagacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcagacaatgcggaggaaggtggggatgacgtcaagtcatcatgccccttatgacctgggctacacacgtactacaatgggtgtcaacaaagagaagcgaaagggcgacctggagccaacctcaaaaacacacccccagttcagatcgcaggctgcaactcgcctgcgtgaagcaggaatcgctagtaatcgcgggtcagcataccgcggtgaatacgttcccgggccttgtacacaccgcccgtcacactatgagagtcagaaacacccgaagccggtgaggtaacc

SEQ ID NO: 767 - DNA, 1547 bp, Dialister sp. oral taxon 502
gagtttgatcctggctcaggacgaacgctggcggcgtgcttaacacatgcaagtcgaacggaaagagatgaaagagcttgctcttttattaatttcagtggcaaacgggtgagtaacacgtaaacaacctgccttagggatggggataacagacggaaacgactgctaataccgaatacgttctaagcatcgcatgatgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtaaatagtgaataactatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagagccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctgtcatttgttgccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcgg

SEQ ID NO: 768 - DNA, 1325 bp, Dialister succinatiphilus
gacgaacgctggcggcgtgcttaacacatgcaagtcgaacgagtggcaaacgggtgagtaacacgtaaacaacctgccttcaggatggggacaacagacggaaacgactgctaataccgaatacggaaagtcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgatgacggtacccgaatagcaagccacggctaactacgtgccagcagccgcggtaatacgtaggtggcaagcgttgtccggaattattgggcgtaaagcgcgcgcaggcggctttctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgaactgacgctgaggcgcgaaagcgtggggagcaaacaggattagataccctggtagtccacgccgtaaacgatgaatactaggtgtaggagcttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattaacaggtggtgcacggctgtcgtcagctcgtgtcgtgagatgttgggttaagtcccgcaacgagcgcaacccctatcttatgttaccagcacgtggggactcatgagagaccgccgcggacaacgcggaggaaggtggggatgacgtcaagtcatcatgccccttatgacctgggctacacacgtactacaatgggtgtcaaagagaagcgaaaccgcgaggtggagcgaacctcaacacccccagttcagatgcaggctgcaacccgcctgcagaagtaggaatcgctagtaatcgcgggtcagcataccgcggtgaatacgttcccgggccttgtacacaccgcccgtcacactatgagagtcggaaacacccgaagccggtaggtagccagccgtcgaaggtggagctgatgattggagtgaagtcgtaacaaggtagccgtatcggaagg

SEQ ID NO: 769 - DNA, 1433 bp, Dietzia natronolimnaea
gcttacacatgcagtcgaacggtaaggccctttcgggggtacacgagtggcgaacgggtgagtaacacgtgggtaatctgccctgcacttcgggataagcctgggaaaccgggtctaataccggatatgagctcctgccgcatggtgggggttggaaagtttttcggtgcaggatgagtccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaactcctttcagtagggacgaagcgaaagtgacggtacctgcagaagaagcaccggccaactacgtgccagcagccgcggtaatacgtagggtgcaagcgttgtccggaattactgggcgtaaagagctcgtaggcggtttgtcacgtcgtctgtgaaatcctccagctcaactgggggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatggggagcaaacaggattagataccctggtagtccatgccgtaaacggtgggcgctaggtgtggggtccttccacggattccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatatacaggacgacggcagagatgtcgtttcccttgtggcttgtatacaggtggtgcatggttgtcgtcagctcgtgtcgtgagatgttgggttaagtcccgcaacgagcgcaacccctgtctcatgttgccagcacgttatggtggggactcgtgagagactgccggggtcaactccggatgaaggtggggatgacgtcaaatcatcatgcccccttatgtctagggcttcacatatgctacaatggctagtacagagggctgcgagaccgcgaggtggagcgaatcccttaaagctagtctcagttcggattggggtctgcaactcgaccccatgaagtcggagtcgctagtaatcgcagatcagcattgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgaacaag

SEQ ID NO: 770 - DNA, 1483 bp, Dietzia sp. BBDP51
agagtttgatcctggctcaggacgaacgctggcggcgtgcttaacacatgcaagtcgaacggtaaggcccttcggggtacacgagtggcgaacgggtgagtaacacgtgggtaatctgccctgcacttcgggataagcctgggaaactgggtctaataccggatatgaactcctgccgcatggtgggggttggaaagtttttcggtgcaggatgagtccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggctaactacgtgccagcagccgcggtaatacgtagggtgcgagcgttgtccggaattactgggcgtaaagagctcgtaggcggtttgtcacgtcgtctgtgaaatccctcggcttaaccgggggcgtgcaggcgatacgggcagacttgagtactacaggggagactggaattcctggtgtagcggtgaaatgcgcagatatcaggaggaaccaccggtggcgaagggcgggtctcttgggtagtaactgacgctgaggagcgaaaagcatgggttagcgaacaggattagataccctgggtagtccatgccgtaaaacggtgggcgctaggtgtggggtccttccacggattccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatatacaggacgacggcagagatgtcgtttcccttgtggcttgtatacaggtggtgcatggttgtcgtcagctcgtgtcgtgagatgttgggttaagtcccgcaacgagcgcaacccctgtctcatgttgccagcacgttatggtggggactcgtgagagactgccggggtcaactcggaggaaggtggggatgacgtcaaatcatcatgccccttatgtctagggcttcacacatgctacaatggctagtacagagggctgcgataccgcgaggtggagcgaatcccttaaagctggtctcagttcggattggggtctgcaactcgaccccatgaagtcggagtcgctggtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtaacc

SEQ ID NO: 771 - DNA, 1467 bp, Dietzia sp. CA149
ttaactgcagtcgacggtaaggccccttcgggggtacacgagtggcgaacgggtgagtaacacgtgggtaatctgccctgcacttcgggataagcttgggaaactgggtctaataccggatatgaactcctgccgcatggtgggggttggaaagtttttcggtgcaggatgagcccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggctaactacgtgccagcagccgcggtaatacgtagggtgcgagcgttgtccggaattactgggcgtaaagagctcgtaggcggtttgtcacgtcgtctgtgaaatccctcggcttaaccgggggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatgggtagcgaacaggattagataccctggtagtccatgccgtaaacggtgggcgctaggtgtggggtccttccacggactccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtaaatcagcatgctacggtgaatacgttcccgggtcttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcaaatccataa

SEQ ID NO: 772 - DNA, 1472 bp, Dietzia timorensis
ggggtgcttacacatgcagtcgaacggtaaggcccttcggggtacacgagtggcgaacgggtgagtaacacgtgggtaatctgccctgcacttcgggataagcctgggaaactgggtctaataccggatattcagcttctgccgcatggtggttgttggaaagtttttcggtgcaggatgtgcccgcggcctatcagcttgttggtggggtaatggcctaccaaggcgacgacgggtagccggcctgagagggtgatcggccacattgggactgagacacggcccagactcctacgggaggcagcagtggggaatattgcacaatgggcgcaagcctgatgcagcgacgccgcgtgagggatgacggtcttcggattgtaaacctctttcggcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaatcctacagcttaactgtgggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatgggtagcgaacaggattagataccctggtagtccatgccgtaaacggtgggcgctaggtgtgggtttccttccacgggatccgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggacgacggcagagatgtcgtttcccttgtggcttgtatacaggtggtgcatggttgtcgtcagctcgtgtcgtgagatgttgggttaagtcccgcaacgagcgcaacccttgtctcatgttgccagcaattcggttggggactcgtgagagactgccggggtcaactcggaggaaggtggggatgacgtcaaatcatcatgccccttagtccagggcttcacacatgctacaatggccggtacagagggctgcgatactgtaaagtggagcgaatctcttaaagccggtctcagttcggattggggtctgcaactcgaccccatgaagtcgagtcgctagtaatcgcagatcagcaatgctgcggtgaatacgttcccgggccttgtacacaccgcccgtcacgtcatgagagtcggtaacacccgaagccggtggcctaacccttgtggggggagccgtcgaaggtgggatcggcgattgggacgaagtcgtaacaaggtacccgtaccggagggtgcggctggatcaaatcaata

SEQ ID NO: 773 - DNA, 1392 bp, Dorea formicigenerans
gtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagct

SEQ ID NO: 774 - DNA, 1392 bp, Dorea longicatena
  modified_base (13)..(13): a, c, t, g, unknown or other
  modified_base (18)..(19): a, c, t, g, unknown or other
  modified_base (21)..(22): a, c, t, g, unknown or other
  modified_base (24)..(25): a, c, t, g, unknown or other
  modified_base (41)..(41): a, c, t, g, unknown or other
gtcgagcgaagcngcttnngnnannagattcttcggatganttcctttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacttcccgatgaccgcttcgtaatggaagtctttcttcggaacatcggtgacagtgggggcatggatgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgtaaggagg

SEQ ID NO: 775 - DNA, 1529 bp, Dysgonomonas gadei
acaaagaagagtttgatcctggctcaggatgaacgctagcgataggcctaacacatgcaagtcgaggggcagcatagggtagcaatactttgatggcgaccggcgcacgggtgagtaacgcgtatgcaacctacctataacaggggaataacccggagaaattcggactaataccgcataaaacaggggctccgcatggagatatttgttaaagatttatcggttatagatgggcatgcgttccattagccagttggtgaggtaacggctcaccaaagcaacgatggataggggaactgagaggtttgtcccccacactggaactgagacacggaccagactcctacgggaggcagcagtgaggaatattggtcaatgggcgagagcctgaaccagccaaatcgcgtgaaggaagactgccttatgggttgtaaacttcttttatacaggaataaaaagagttacgtgtaacttattgcatgtactgtatgaataagcatcggctaactccgtgccagcagccgcggtaatacggaggatgcgagcgttatccggatttattgggtttaaagggtgcgcaggcgggaacttaagtcagcggtgaaatctcgacgcttaacgtcgaaactgccgttgaaactgggtttcttgagtatagatgaagtaggcggaattcgttgtgtagcggtgacatgcttagatataacgaggaactccgattgcgtaggcagcttactaagctataactgacgctcaagcacgaaagcgtggggatcaaacaggattagataccctggtagtccacgccgtaaacgatgattactagttgtatgcgatataccgtatgtgactaagcgaaagcgataagtaatccacctggggagtacgccggcaacggtgaaactcaaaggaattgacgggggcccgcacaagcggaggaacatgtggtttaattcgatgatacgcgaggaaccttacccgggcttgaaatgcagaagaataacgttgaaagatgttagccagcaatggcttctgtgtaggtgctgcatggttgtcgtcagctcgtgccgtgaggtgtcggcttaagtgccataacgagcgcaacccacattgttagttactaacaggtcaagctgaggactctaacaagactgccgtcgtaagatgcgaggaaggtgtggatgacgtcaaatcagcacggcccttacgtccggggcgacacacgtgttacaatgggtggtacaaagggcagctacttggtgacaagatgctaatctccaaagccactcccagttcggatcggagtctgcaactcgactccgtgaagctggattcgctagtaatcgcgcatcagccatggcgcggtgaatacgttcccgggccttgtacacaccgcccgtcaagccatggaagctgggggtatctgaagtgcgtaaccgcaaggagcgtcctagggtaaaaccggtgactggggctaagtcgtaacaaggtagccgtaccggaaggtgcggctggaacacctcctttct

SEQ ID NO: 776 - DNA, 1003 bp, Dysgonomonas mossii
  modified_base (879)..(879): a, c, t, g, unknown or other
  modified_base (972)..(974): a, c, t, g, unknown or other
  modified_base (979)..(981): a, c, t, g, unknown or other
  modified_base (991)..(992): a, c, t, g, unknown or other
agtcgaggggcagcatagagtagcaatactttgatggcgaccggcgcacgggtgagtaacacgtatgcaacctacctacatcaggggaataacccggagaaattcggactaataccgcataatacagggatgccgcatggcaatatttgttaaagatttatcggatgtagatgggcatgcgttccattagctagttggtaaggtaacggcttaccaaggcaacgatggataggggaactgagaggtttgtcccccacactggaactgagacacggaccagactcctacgggaggcagcagtgaggaatattggtcaatggacgagagtctgaaccagccaaatcgcgtgaaggaagactgccctacgggttgtaaacttcttttgtacaggaataaaagacattacgtgtaatgtattgcatgtactgtacgaataagcatcggctaactccgtgccagcagccgcggtaatacggaggatgcgagcgttatccggatttattgggtttaaagggtgcgcaggcgggattttaagtcagcggtgaaattttcaggctcaacctgaacactgccgttgaaactgggattcttgagtatggatgaagtaggcggaattcgttgtgtagcggtgacatgcttagatataacgaggaactccgattgcgtaggcagcttactaagccataactgacgctcaagcacgaaagcgtggggatcaaacaggattagataccctggtagtccacgccgtaaacgatgattactagttgtttgcgatataccgtaagtgactaagcgaaagcgataagtaatccacctggggagtacgccggcaacggtgaaactcaaaggaattgacgggggcccgcacaagcggangaacatgtggtttaattcgatgatacgcgaggaaccttacccgggcttgaaatgtacctgaccgtccttgaaaagggacttctagcaatagcnnnatgtnnngctgcatggnngtcgtcagctc

SEQ ID NO: 777 - DNA, 1547 bp, Edwardsiella tarda
tttaattgaagagtttgatcatggctcagattgaacgctggcggcaggcttaacacatgcaagtcgagcggtagcagggagaaagcttgctttctccgctgacgagcggcggacgggtgagtaatgtctggggatctgcctgatggagggggataactactggaaacggtagctaataccgcataacgtcgcaagaccaaagtgggggaccttcgggcctcatgccatcagatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtgtgaacgttaatagcgctcacaattgacgttacctacagaagaagcaccggctaactccgtgccagcagccgcggtaatacggagggtgcaagcgttaatcggaattactgggcgtaaagcgcacgcaggcggtttgttaagttggatgtgaaatccccgggcttaacctgggaactgcatccaagactggcaagctagagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgctgtaaacgatgtcgatttggaggttgtgcccttgaggcgtggcttccgaagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctgtagagatacgggagtgccttcgggaacgctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 778 - DNA, 999 bp, Eggerthella lenta
  modified_base (33)..(36): a, c, t, g, unknown or other
  modified_base (57)..(57): a, c, t, g, unknown or other
  modified_base (119)..(119): a, c, t, g, unknown or other
  modified_base (788)..(788): a, c, t, g, unknown or other
  modified_base (848)..(848): a, c, t, g, unknown or other
  modified_base (860)..(860): a, c, t, g, unknown or other
  modified_base (877)..(877): a, c, t, g, unknown or other
  modified_base (887)..(887): a, c, t, g, unknown or other
  modified_base (891)..(891): a, c, t, g, unknown or other
  modified_base (899)..(899): a, c, t, g, unknown or other
  modified_base (933)..(934): a, c, t, g, unknown or other
  modified_base (961)..(961): a, c, t, g, unknown or other
  modified_base (963)..(963): a, c, t, g, unknown or other
  modified_base (978)..(978): a, c, t, g, unknown or other
  modified_base (980)..(980): a, c, t, g, unknown or other
  modified_base (983)..(983): a, c, t, g, unknown or other
cctcgggcggacatgaagtggcgaacgggtgannnncacgtgaccaacctgcccccngctccgggacaaccttgggaaaccgaggctaataccggatactccctcccctgctcctgggngggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggncgcaaggctaaaactcaaggaattgacgggggcccgcacaagcagcggagcatgtggctnaattcgaagcancgcgaagaaccttaccngggcttgacntggnacgtgaanccggggaaacccggtggccgagaggagcgtccgnnagtggtgcatggctgtcgtcagctcgngncgtgagatgttgggntnagntcccgcaacgagcgca

SEQ ID NO: 779 - DNA, 1429 bp, Eggerthella sinensis
gatgaacgctggcggcgtgcctaacacatgcaagtcgaacgattaaaccgtcctcggacggacatagagtggcgaacgggtgagtaacacgtgaccaacctgccccccgctccgggacaaccttgggaaaccgaggctaataccggatactcctcgcccccctcctggggggcccgggaaagcccagacggcgggggatggggtcgcggcccattaggtagacggcggggtaacggcccaccgtgcctgcgatgggtagccgggttgagagaccgaccggccacattgggactgagatacggcccagactcctacgggaggcagcagtggggaattttgcgcaatgggggaaaccctgacgcagcaacgccgcgtgcgggatgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctttcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgaaactgacgctgaggcgcgaaagctaggggagcgaacaggattagataccctggtagtcctagccgtaaacgatgggcgctaggtgtggggagggtcatcctctccgtgcccgcagctaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgctagtgaagccggggaaacccggtggccgagaggagctagcgcaggtggtgcatggctgtcgtcagctcgtgtcgtgagatgttgggttaagtcccgcaacgagcgcaacccctatcgcatgttgccagcattcagttggggactcatgcgagactgccggcgtcaagccggaggaaggtggggacgacgtcaagtcatcatgccctttatgccctgggctgcacacgtgctacaatggccggtacaacgggctgcgaactcgcgagagtgagcgaatcccttaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggg

SEQ ID NO: 780 - DNA, 1346 bp, Eggerthella sp. 1_3_56FAA
  modified_base (123)..(123): a, c, t, g, unknown or other
  modified_base (1329)..(1329): a, c, t, g, unknown or other
accgccctcgggcggacatgaagtggcgaacgggtgagtaacacgtgaccaacctgcccccctctccgggacaaccttgggaaaccgaggctaataccggatactccctcccctgctcctggnggggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcaggcctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttagttcgaagcaacgcgaagaacctcaccaggcctgatcccgaactggaagccggggaaacccggtggccgagaggaacgtccgcaggtggtgcatggctgtcgtcagctcgtgtcgtgacatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccntccgaacccgcaagggg

SEQ ID NO: 781 - DNA, 1430 bp, Eggerthella sp. HGA1
gaacgctggcggcgtgcctaacacatgcaagtcgaacgatgaaaccgccctcgggcggacatgaagtggcgaacgggtgagtaacacgtgaccaacctgcccccctctccgggacaaccttgggaaaccgaggctaataccggatactccctcccctgctcctgcaggggtcgggaaagcccaggcggagggggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggcaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttaattcgaagcaacgcgaagaaccttaccagggcttgacatggacgtgaagccggggaaacccggtggccgagaggagcgtccgcaggtggtgcatggctgtcgtcagctcgtgtcgtgagatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaa

SEQ ID NO: 782 - DNA, 753 bp, Eggerthella sp. YY7918
  modified_base (122)..(122): a, c, t, g, unknown or other
  modified_base (197)..(197): a, c, t, g, unknown or other
  modified_base (341)..(341): a, c, t, g, unknown or other
  modified_base (431)..(431): a, c, t, g, unknown or other
  modified_base (508)..(508): a, c, t, g, unknown or other
  modified_base (602)..(602): a, c, t, g, unknown or other
  modified_base (620)..(621): a, c, t, g, unknown or other
  modified_base (623)..(623): a, c, t, g, unknown or other
  modified_base (627)..(627): a, c, t, g, unknown or other
  modified_base (670)..(670): a, c, t, g, unknown or other
  modified_base (676)..(676): a, c, t, g, unknown or other
  modified_base (709)..(709): a, c, t, g, unknown or other
  modified_base (739)..(739): a, c, t, g, unknown or other
ctacccttctcttcgggacaaccttgggaaaccgaggctaataccgaatactccggtgagtgcgcatgcacacgccgggaaagctttcgcggagaaggatggggtcgcggcccatcaggtanacggcggggtagcggcccaccgtgcttttgacgggtagccgggttgagagaccgaccggccacattgggactganatacggcccagactcctacgggaggcagcagtggggaattttgcgcaatgggggaaaccctgacgcagcaccgccgcgtgcgggatgaaggccttcgggtcgtaaaccgctttcagcagggaagaaattcgacggtacctgcanaagaagccccggctaactacgtgccagcagccgcggtaatacgtagggggcgagcgttatccggattcattgggcgtaaagcgcgcgtangcggccgcctaagcgggacctctaaccttggggctcaacctcaagccgggttccgaactgggtggctcgagtttggnagaggaagatggaattcccggtgtagcggtggaatgcgcagatatcgggaagaacaccgatggcgaaggcagtcttctgggctcataactgacnctgaagcgcgaaagctanngnagcnaacaggattagataccctggtagtcctagccgtaaacgatggncactangtgtggggagatactctttccgtgccgaagcanacgcattaagtgccccgcctggggagtacngccgcaaggctaaa

SEQ ID NO: 783 - DNA, 1510 bp, Ehrlichia chaffeensis
tcaaacttgagagtttgatcctggctcagaacgaacgctggcggcaagcctaacacatgcaagtcgaacggacaattgcttataaccttttggttataaataattgttagtggcagacgggtgagtaatgcgtaggaatctacctagtagtatggaatagccattagaaatgatgggtaatactgtataatccctgcgggggaaagatttatcgctattagatgagcctacgttagattagctagttggtaaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaaactctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccaaggcttaactttggagcggcttttaatactgctagactagaggtcgaaagaggatagcggaattcctagtgtagaggtgaaattcgtagatattaggaggaacaccagtggcgaaagcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatccctcctaatagggggagtcagttcggctggaccttacacaggtgctgcatggctgtcgtcagctcgtgtcgtgagatgttgggttaagtcccgcaacgagcgcaaccctcatccttagttaccaacaggtaatgctgggcactctaaggaaactgccagtgataaactggaggaaggtggggatgatgtcaagtcagcacggcccttataaggtgggctacacacgtgctacaatggcaactacaataggtcgcgagaccgcaaggtttagctaatccataaaagttgtctcagttcggattgttctctgcaactcgagagcatgaagtcggaatcgctagtaatcgtggatcatcatgccacggtgaatacgttctcgggtcttgtacacactgcccgtcacgccatgggaattggcttaactcgaagctggtgtgctaaccgcaaggaagcagccatttaaggttgggttagtgactagggtgaagtcgtaacaaggtagctgtaggtgaacctgcggctggattacctccttt

SEQ ID NO: 784 - DNA, 1546 bp, Eikenella corrodens
ttgaacataagagtttgatcctggctcagattgaacgctggcggcatgctttacacatgcaagtcgaacggcagcggggtagtgcttgcactactgtccggcgagtggcgaacgggtgagtaatatatcggaacgtaccgagtaatgggggataaccaatcgaaagattggctaataccgcatacgtcctacgggagaaagcgggggatcgcaagacctcgcgttattcgagcggccgataactgattagctagttggtggggtaaaggcctaccaaggcgacgatcagtagcgggtctgagaggacgatccgccacactgggactgagacacggcccagactcctacgggaggcagcagtggggaattttggacaatgggggcaaccctgatccagccatgccgcgtgtatgaagaaggccttcgggttgtaaagtacttttgttagggaagaaaagggaagtgctaataccactttttgctgacggtacctaaagaataagcaccggctaactacgtgccagcagccgcggtaatacgtagggtgcgagcgttaatcggaattactgggcgtaaagcgagcgcagacggttatttaagcaggatgtgaaatccccgggcttaacctgggaactgcgttctgaactggatagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcgattagctgttgggcaacttgattgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtagggtaaccgcaaggagcccgcttgccacggtatgcttcatgactggggtgaagtcgtaacaaggtagccgtaggggaacctgcggctggatcacctcctttct

SEQ ID NO: 785 - DNA, 1533 bp, Enhydrobacter aerosaccus
taaactgaagagtttgatcatggctcagattgaacgctggcggcaggcttaacacatgcaagtcgaacgatgattatctagcttgctagatatgattagtggcggacgggtgagtaacatttaggaatctgcctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcctgcagagatgcgggagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtgaagtcgtaacaaggtagccgtaggggaacctgcggctggatcacctcctta

SEQ ID NO: 786 - DNA, 1396 bp, Enterobacter aerogenes
  modified_base (9)..(9): a, c, t, g, unknown or other
  modified_base (13)..(13): a, c, t, g, unknown or other
gcggtaacncaanaagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttggcgattgacgttactcgcagaagaagcaccggctaactccgtgccagcagccgcggtaatacgggggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 787 - DNA, 597 bp, Enterobacter asburiae
cagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaatgaattgacgggggccc

SEQ ID NO: 788 - DNA, 1495 bp, Enterobacter cancerogenus
attgaacgctggcggcaggcctaacacatgcaagtcgarcggtarcacagagagcttgctctcgggtgacgagyggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaascctgatgcagccatgccgcgtgtatgaagaaggccttcgggttgtaaagtactttcagcggggaggaaggcgataaggttaataaccttgtcgattgacgttacccgcagaaraagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtcmggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctycgggagggcgcttaccactttgtgattcatgactggggtgaagtcgtaacaaggtaaccgtaggggaacctgc

SEQ ID NO: 789 - DNA, 1395 bp, Enterobacter cloacae
tcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagaaatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagg

SEQ ID NO: 790 - DNA, 1362 bp, Enterobacter cowanii
  modified_base (982)..(983): a, c, t, g, unknown or other
ggcggcaggcctaacacatgcaagtcgaacggtaacaggaagcagcttgctgcttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggannggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagcaygcggacctcataaagtgcgtcgtagtccggattggagtctgcaactcgactccatgaagtcggaatcgctagtaatcgtgaatcagaatgtcacggtgaatacgttcccgggccttgtacacaccg

SEQ ID NO: 791 - DNA, 943 bp, Enterobacter hormaechei
gtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggag

SEQ ID NO: 792 - DNA, 1390 bp, Enterobacter sp. 247BMC
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtccattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgatacagtgtgaaatcgccgggctccagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgct

SEQ ID NO: 793 - DNA, 1532 bp, Enterobacter sp. 638
agagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 794 - DNA, 943 bp, Enterobacter sp. JC163
  modified_base (88)..(88): a, c, t, g, unknown or other
  modified_base (126)..(126): a, c, t, g, unknown or other
  modified_base (129)..(129): a, c, t, g, unknown or other
  modified_base (148)..(148): a, c, t, g, unknown or other
  modified_base (233)..(233): a, c, t, g, unknown or other
  modified_base (475)..(476): a, c, t, g, unknown or other
  modified_base (489)..(490): a, c, t, g, unknown or other
  modified_base (494)..(494): a, c, t, g, unknown or other
  modified_base (497)..(498): a, c, t, g, unknown or other
  modified_base (507)..(508): a, c, t, g, unknown or other
  modified_base (511)..(511): a, c, t, g, unknown or other
  modified_base (527)..(527): a, c, t, g, unknown or other
  modified_base (624)..(624): a, c, t, g, unknown or other
  modified_base (628)..(628): a, c, t, g, unknown or other
  modified_base (781)..(781): a, c, t, g, unknown or other
  modified_base (927)..(927): a, c, t, g, unknown or other
ccgtgccagcagccgcggtaatacggagggtgcaagcgttaatcggaattactgggcgtaaagcgcacgcaggcggtctgtcaagtcngatgtgaaatccccgggctcaacctgggaactgcattnganactggcaggctggagtctngtagaggggggtagaattccaggtgtagcggtgaaatgcgtagagatctggaggaataccggtggcgaaggcggccccctggacnaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctnntcttgacatccanngaanttnncagagatgnnttngtgccttcgggaactntgagacaggtgctgcatggctgtcgtcagctcgtgttgtgaaatgttgggttaagtcccgcaacgagcgcaacccttatcctttgttgccagcgrtncggncgggaactcaaaggagactgccagtgataaactggaggaaggtggggatgacgtcaagtcatcatggcccttacgasyagggctacacacgtgctacaatggcryatacaaagagaagcgacctcgcgagagcaagcggacctcataaagtrngtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagntagcttaaccttcggg

SEQ ID NO: 795 - DNA, 920 bp, Enterobacter sp. SCSS
  modified_base (59)..(60): a, c, t, g, unknown or other
  modified_base (100)..(102): a, c, t, g, unknown or other
  modified_base (107)..(110): a, c, t, g, unknown or other
  modified_base (124)..(124): a, c, t, g, unknown or other
  modified_base (153)..(153): a, c, t, g, unknown or other
  modified_base (179)..(179): a, c, t, g, unknown or other
  modified_base (216)..(216): a, c, t, g, unknown or other
  modified_base (282)..(282): a, c, t, g, unknown or other
  modified_base (295)..(295): a, c, t, g, unknown or other
  modified_base (300)..(300): a, c, t, g, unknown or other
  modified_base (309)..(309): a, c, t, g, unknown or other
  modified_base (314)..(314): a, c, t, g, unknown or other
  modified_base (319)..(319): a, c, t, g, unknown or other
  modified_base (910)..(911): a, c, t, g, unknown or other
aatacggagggtgcaagcgttaatcggaattactgggcgtaaagcgcacgcaggcggtnngtcaagtcagatgtgaaatccccgggctcaacctgggaannngcatnnnnaactggtcaggctngagtctcgtagaggggggtagaattccangtgtagcggtgaaatgcgtagagatntggaggaataccggtggcgaaggcggccccctggacnaagactgacgctcaggtgcgaaagcgtggggagcaaacaggattagataccctggtagtccacgcngtaaacgatgtcnatttngaggttgtnccctngaggngtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgcttgggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaaccggaggaaggtggggatgacgtcaagtcatcatggcccttacgactagggctacacacgtgctacaatggcgtatacaaagagaagcgacctcgcgagagcaagcggacctcataaagtatgtcgtagtccggattggagtctgcaactcgactccatgaagtcggaatcgctagtaatcgtagatcagaatgccacggtgaatacgttcccgggccttgtacacaccgcccgtcacaccatgggagtgggttgcaaaagaagtagnntagcttaac

SEQ ID NO: 796 - DNA, 1377 bp, Enterobacter sp. TSE38
  modified_base (1357)..(1363): a, c, t, g, unknown or other
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgactccagagaacttcagaatgattgggccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagnnnnnnncttaaccttcggga

SEQ ID NO: 797 - DNA, 1546 bp, Enterobacteriaceae bacterium 9_2_54FAA
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcatgacgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgagcttaacttgggaactgcatttgaaactggtcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgaataatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 798 - DNA, 1314 bp, Enterobacteriaceae bacterium CF01Ent-1
tggctcagattgaacgctggcggcaggcctaacacatgcaagtcgagcgagcggcggacgggtgagtaatgtctgggaaactgcccgatggagggggataactactggaaacggtagctaataccgcataaccaaagttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggatgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgccgtaaacgatgtcgacttggaggttgtgcgtggcttccggagctaacgcgttaagtcgaccgcctggggagtacggycgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcgcacaaagagaagcgacctcgcgagagcaagcggacctcattgcgtcgtagtccggatggagtctgcaactcgactccagaagtcggaatcgctagtaatcgtagatcagaatgctacggtgaatacgttcccgggccttgtacacaccgcccgtcacaccatgggagtgggttgcaaaagaagtaggtgcttagggcgcttaccactttgtgattcatgactggggtgaagtcgtaac

SEQ ID NO: 799 - DNA, 1485 bp, Enterobacteriaceae bacterium Smarlab 3302238
tagagtttgatcctggctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtg

SEQ ID NO: 800 - DNA, 1403 bp, Enterococcus avium
tttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggtttcggtttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgcaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaggttgaaactcaaaggaattgacgggggcccgcacaagcggtggacatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagcc

SEQ ID NO: 801 - DNA, 1483 bp, Enterococcus caccae
gacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtg

SEQ ID NO: 802 - DNA, 1559 bp, Enterococcus casseliflavus
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttct

SEQ ID NO: 803 - DNA, 1397 bp, Enterococcus durans
tcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgagctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggatcatgtggtttaattcgaagcaacgcgaagaaacttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtg

SEQ ID NO: 804 - DNA, 1421 bp, Enterococcus faecalis
  modified_base (1411)..(1411): a, c, t, g, unknown or other
gtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgagctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggcttcagtcgcagtaatacgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttnggagccagcc

SEQ ID NO: 805 - DNA, 1422 bp, Enterococcus faecium
  modified_base (1411)..(1411): a, c, t, g, unknown or other
tcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttnggagccagccg

SEQ ID NO: 806 - DNA, 1254 bp, Enterococcus gallinarum
agtggcgaacgggtgagtaacacgtgggtaacctgcccatcagaaggggataacacttggaaacaggtgctaataccgtataacgaaagtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgactgacgctgaggctcgaaagcgtggggagcgaacaggattagataccctggtagtccacgccgtaaacgatgagtgctaagtgttggagcttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtgacaaaccggaggaaggtggggatgacgtcaaatcatcatgccccttatgacctgggctacacacgtgctacaatgggaagcaacgagttgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 807 - DNA, 1295 bp, Enterococcus gilvus
acgctttttctttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctgaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcg

SEQ ID NO: 808 - DNA, 1295 bp, Enterococcus hawaiiensis
gacgaacgctggcggcgtgcctaatacatgcaagtcgaacgagtggcgaacgggtgagtaacacgtgggtaacctgcccatcagaaggggataacacttggaaacaggtgctaataccgtataatgaaagtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgactgacgctgaggctcgaaagcgtggggagcaaacaggattagataccctggtagtccacgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtgacaaaccggaggaaggtggggatgacgtcaaatcatcatgccccttatgacctgggctacacacgtgctacaatgggaagcaacgagtcgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 809 - DNA, 1395 bp, Enterococcus hirae
  modified_base (950)..(950): a, c, t, g, unknown or other
gtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggggcacttcggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaggttgaaactcaaaggaattgacgggggcccgcacaagcggtggaccatgtggtttaattcgaagcaacgcgaagatagttgccaggcgttgtccgcnttttactggtctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggt

SEQ ID NO: 810 - DNA, 1559 bp, Enterococcus italicus
ttttatgagagtttgatcctggctcaggacgaacgctggcggcgtgcctaatacatgcaagttgaacgcttctttcttatcgaacttcggttcaccaagaaagaagagtagcgaacgggtgagtaacacgtgggtaacctgcccatcagcgggggataacacttggaaacaggtgctaataccgcataatactttttctctcatgagtgaaagttgaaaggcgcttttgcgtcactgatggatggacccgcggtgcattagctagttggtagggtaacggcctaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagaagagaatgttcatcccttgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttct

SEQ ID NO: 811 - DNA, 1529 bp, Enterococcus mundtii
acgaacgctggcggcgtgcctaatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaagggtgagagtaactgttcaccccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctc

SEQ ID NO: 812 - DNA, 1396 bp, Enterococcus raffinosus
  modified_base (8)..(8): a, c, t, g, unknown or other
  modified_base (13)..(13): a, c, t, g, unknown or other
cgaacgcnttttntttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggcggtaatacgtgggtggcaagcgttaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtg

SEQ ID NO: 813 - DNA, 876 bp, Enterococcus sp. BV2CASA2
  modified_base (34)..(34): a, c, t, g, unknown or other
  modified_base (41)..(41): a, c, t, g, unknown or other
  modified_base (47)..(47): a, c, t, g, unknown or other
  modified_base (247)..(247): a, c, t, g, unknown or other
  modified_base (850)..(850): a, c, t, g, unknown or other
  modified_base (853)..(853): a, c, t, g, unknown or other
atttattgggcgtaaagcgagcgcaggcggtttnttaagtntgatgngaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtncacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcncancacgagagtttgtaacacccgaa

SEQ ID NO: 814 - DNA, 1262 bp, Enterococcus sp. CCRI-16620
gaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacycctattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcg

SEQ ID NO: 815 - DNA, 1522 bp, Enterococcus sp. F95
agggtttgatcctggctcaggacgaacgctggcggcgtgcctaatacatgcaagtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctataccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagcc

SEQ ID NO: 816 - DNA, 1406 bp, Enterococcus sp. RfL6
tcacttgaaaagaagagtggcggacggggtgagtaacacgtgggtaacctgccccatcagagggggataagacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggccagactcctacgggaggcagcagtagggaatcttcggcaatggacgaagtctgaccgagcaacgccgcgtgagtgaagaaggttttcggatcgtaaaactctgttgttagagaagaacaagtgggagagtaactgctcccgccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagttgaattccatgtgtagcgtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattkacgggggcccgcacaagcggtggagcatgtggtttaattcgaagcaacgcggagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaaccttttggagccagccgcctaaggtgggatagatg

SEQ ID NO: 817 - DNA, 1295 bp, Enterococcus thailandicus
gacgaacgctggcggcgtgcctaatacatgcaagtcgtacgagtggcgaacgggtgagtaacacgtgggtaacctgcccatcagaaggggataacacttggaaacaggtgctaataccgtataacgaaagtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgactgacgctgaggctcgaaagcgtggggagcaaacaggattagataccctggtagtccacgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcaagactgccggtgacaaaccggaggaaggtggggatgacgtcaaatcatcatgccccttatgacctgggctacacacgtgctacaatgggaagcaacgagtcgcgaagtcgcgaggctaagctaatctcttcttctctcagttcggatgtaggctgcaactcgcctacagaagccggaatcgctagtaatcgcggatcagcacgccgcggtgaatacgttcccgggccttgtacacaccgcccgtcacaccacgaaagtttgtaacacccgaagtcggtaggtagccagccgcctaaggtgggatagatgattggggtg

SEQ ID NO: 818 - DNA, 1543 bp, Eremococcus coleocola
atgagagtttgatcctggctcaggacgaacgctggcggcgtgcctaatacatgcaagtcgaacgcactgacggagaacttgttctcttaacgtgagtggcggacgggtgagtaacacgtgggaaacctacccttgagcgggggataacggtcggaaacgatcgctaataccgcataacagcaatcatcgcctgatggttgattgaaagatggctctgctatcactcaaggatgggcccgcggtgcattagctagttggtaaggtaacggcttaccaaggccatgatgcatagccgacctgagagggtaatcggccacattgggactgagacacggcccaaactcctacgggaggcagcagtagggaatcttccgcaatggacgcaagtctgacggagcaacgccgcgtgtgtgaagaaggttttcggatcgtaaagcactgttattagccaagaacacccctagtagtaactggctagggattgacggtaactaatcagaaagccacggctaactacgtgccagcagccgcggtaatacgtaggtggcaagcgttgtccggatttattgggcgtaaagggagcgcaggcggtgacttaagtctgatgtgaaagcccacggcttaaccgtggagggtcattggaaactgggtcacttgagtacagaagaggaaagcggaattccatgtgtagcggtgaaatgcgtagatatatggaggaacaccagtggcgaaggcggctttctggtctgatactgacgctgaggctcgaaagcgtggggagcaaacaggattagataccctggtagtccacgccgtaaacgatgagtgctaagtgttggagggtttccacccttcagtgctggcgttaacgcaataagcactccgcctggggagtacggtcgcaagactgaaactcaaaggaattgacggggacccgcacaagcggtggagcatgtggtttaattcgaagcaacgcgaagaaccttaccaggtcttgacatcctatgaccactctagagatagagtttctcttcggagcatagagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggacgatacaacgagcagcaaactcgcgagggcaagcgaatctcttaaagtcgttctcagttcggattgcaggctgcaactcgcctgcatgaagccggaatcgctagtaatcgtggatcagcacgccacggtgaatccgttcccgggtcttgtacacaccgcccgtcacaccacgagagtttgtaacacccgaagccggtggcctaacctatgagggagccgtcgaaggtgggatagatgattggggtgaagtcgtaacaaggtagccgtatcggaaggtgcggctggatcacctcctttct

SEQ ID NO: 819 - DNA, 1504 bp, Erysipelothrix inopinata
ggctcaggatgaacgctggcggcgtgcctaatacatgcaagtcgaacgaagttcgaaactagcttgctagattcgaaacttagtggcgaacgggtgagtaatacataagcaacctgcctctatgcctgggataacagatggaaacgtctgctaataccggatacgttaatcgaagacatcttcgattaattaaagttgggatacaacacaaagagatgggcttatggcgcattagttagttggtgaggtaacggctcaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagaaggccttcgggttgtaaagctctgttgtaagggaagaacaagtatgagagggaatgctcgtactatgacggtaccttaccagaaagccacggctaactacgtgccagcagccgcggtaatacgtaggtggcgagcgttatccggaattattgggcgtaaagggagcgcaggcggtttattaagtttatggtgaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggatagaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcatagagatatgtaatagttatggcggatacaggtggtgcatggttgtcgtcagctcgtgtcgtgagatgttgggttaagtcccgcaacgagcgcaacccttgtcttcagttaccatcattaagttggggactctggagagactgccggtgataaaccggaggaaggtggggatgacgtcaaatcatcatgccccttatgatctgggctacacacgtactacaatggcgtatacagagggaagcgaagcagtgatgtggagcgaatctcagaaagtacgtctcagttcggattggagtctgcaactcgactccatgaagtcggaatcgctagtaatcgcggatcagcatgccgcggtgaatacgttctcgggccttgtacacaccgcccgtcaaaccatgagagttggtaatacccgaagccggtggcctaaccctgtaaagggagggagccgtcgaaggtaggaccgatgattggggttaagtcgtaacaaggtatccctaccggaaggtggg

SEQ ID NO: 820 - DNA, 1545 bp, Erysipelothrix rhusiopathiae
aaatggagagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaagacatcttagattaattaaagatgggatacatcacaacgagatgggcttatggcgcattagttagttggtaaggtaacggcttaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagacggccttcgggttgtaaagctctgttgtaagggaagaacgataggaagagggaatgcttcttatatgacggtaccttaccagaaagccacggctaactacgtgccagcagccgcggtaatacgtaggtggcaagcgttatccggaattattgggcgtaaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggcctaacctagtttactaggagggagccgtcgaaggtaggatcgatgattggggttaagtcgtaacaaggtatccctaccggaaggtggggatggatcacctcctttctaagga

SEQ ID NO: 821 - DNA, 1479 bp, Erysipelothrix tonsillarum
agagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaagacatcttagattaattaaagatgggatacatcacaacgagatgggcttatggcgcattagttagttggtaaggtaacggcttaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagacggccttagggttgtaaagctctgttgtaagggaagaacaataagaagagggaatgcttcttatatgacggtaccttaccagaaagccacggctaactacgtgccagcagccgcggtaatacgtaggtggcaagcgttatccggaattattgggcgtaaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggcctaacctagtttactaggagggagccgtcgaaggtaggatcgatgattgggg

SEQ ID NO: 822 - DNA, 1387 bp, Erysipelotrichaceae bacterium 3_1_53
  modified_base (935)..(936): a, c, t, g, unknown or other
  modified_base (1381)..(1381): a, c, t, g, unknown or other
tctctaggaagcttgcttccaaagagacttagtggcgaacgggtgagtaacacgtaggtaacctgcccatgtgtctgggataactgctggaaacggtagctaaaaccggataggtatacggagcgcatgctctgtatattaaagcacccttcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcataggaaatgctatgggagtgaggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggtcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaannccctagagatagggagataaatatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagngagccg

SEQ ID NO: 823 - DNA, 1357 bp, Erysipelotrichaceae bacterium 5_2_54FAA
  modified_base (14)..(14): a, c, t, g, unknown or other
  modified_base (1311)..(1312): a, c, t, g, unknown or other
tccaaagagacttngtggggaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggagcttaccagaaagccacggtaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatgtatataaatgatctagaaatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccnncaaaccatgggagttggtaatacccgaagccggtggcataaccgc

SEQ ID NO: 824 - DNA, 1545 bp, Escherichia albertii
ttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatctgatactggtcagcttgagtctcgtagaggggggtagaattccaggtgtagcggtgaaatgcgtagagatctggaggaataccggtggcgaaggcggccccctggacgaagactgacgctcatgtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 825 - DNA, 1403 bp, Escherichia coli
  modified_base (20)..(20): a, c, t, g, unknown or other
gtcgaacggtaacaggaagncagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcagtgcgaaagcgtggggagcaaacaggattagataccctggtagtccacgccgtaaacgatgtcgacttggaggttgtgcccttgaggcgtggcttcggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcta

SEQ ID NO: 826 - DNA, 1395 bp, Escherichia fergusonii
  modified_base (14)..(16): a, c, t, g, unknown or other
tcgaacggtaacannnagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaaaaaccttacctggtcttgacatccacagaactttccagagatggatgcgtaacgtgcaggaaggcggtttgtgaagtcagatgctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcggga

SEQ ID NO: 827 - DNA, 1517 bp, Escherichia hermannii
ctccagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaac

SEQ ID NO: 828 - DNA, 1542 bp, Escherichia sp. 1_1_43
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctta

SEQ ID NO: 829 - DNA, 1530 bp, Escherichia sp. 4_1_40B
agagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacct

SEQ ID NO: 830 - DNA, 1334 bp, Escherichia sp. B4
gagtttgatcctggctcagattgaacgctggcggcaggcctaacacatgcaagtcgaacgagtggcggacgggtgagtaatgtctgggaaactgcctgatggagggggataactactggaaacggtagctaataccgcataaccaaagttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaactgacgctcaggtgcgaaagcgtggggagcaaacaggattagataccctggtagtccacgccgtaaacgatgtcgacttggaggttgtgcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgaccagggctacacacgtgctacaatggcgcacaaagagaagcgaactcgcgagagcaagcggacctcattgcgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccactttgtgattcatgactggggtgaagtcgtaacaaggtaacc

SEQ ID NO: 831 - DNA, 1397 bp, Escherichia vulneris
agtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggacgcacgcaggcggtctgtcaagtcggatgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagg

SEQ ID NO: 832 - DNA, 1497 bp, Ethanoligenens harbinense
agagtttgatcctggctcaggacgaacgctggcggcgcgcctaacacatgcaagtcgagcggagtccttcgggacttagcggcggacgggtgagtaacgcgtgagcaacctggccttcagagggggataacgtctggaaacggacgctaataccgcatgacatggcggagtcgcatggctctgccatcaaaggagtaatccgctgagggatgggctcgcgtccgattaggtagttggtgaggtaacggctcaccaagcccgcgatcggtagccggactgagaggttggccggccacattgggactgagacacggcccagactcctacgggaggcagcagtgggggatattgcacaatggaggaaactctgatgcagcgacgccgcgtgagggaagaaggtcttcggattgtaaacctctgtctttggggacgaatcaatgacggtacccaaggaggaagccacggctaactacgtgccagcagccgcggtaatacgtaggtggcaagcgttgtccggaattactgggtgtaaagggtgcgcaggcggggcggcaagttggatgtgaaaactccgggctcaacccggagcctgcattcaaaactgtcgctcttgagtgaagtagaggcaggcggaattcccggtgtagcggtgaaatgcgtagatatcgggaggaacaccagtggcgaaggcggcctgctgggcttttactgacgctgaggcacgaaagcatgggtagcaaacaggattagataccctggtagtccatgccgtaaacgatgattgctaggtgtggggggtctgaccccttccgtgccggagttaacacaataagcaatccacctggggagtacgggtcgcaaggttgaaactcaaaggaattgacgggggctcgcacaagcagtggagtatgtggtttgattcgaagcaacgcgaagaaccttaccaggtcttgacatccaccgaatcccccagagattggggagtgcccttcggggagcggtgagacaggtggtgcatggttgtcgtcagctcgtgtcgtgagatgttgggttaagtcccgcaacgagcgcaacccttgtgaatagttgctacgaaagagcactctattcagaccgccgttgacaaaacggaggaaggtggggatgacgtcaaatcatcatgccccttatgacctgggctacacacgtactacaatggccatcaacagagggaagcaaggccgcgaggtggagcgaacccctaaaaatggtctcagctcagattgcaggctgaaacccgcctgcatgaagatggaattgctagtaatcgcggatcagcatgccgcggtgaatacgttcccgggccttgtacacaccgcccgtcacaccatgagagccggggacacccgaagtcggttgggtaaccgtaaggagcccgccgccgaaggtggaatcggtaattggggtgaagtcgtaacaaggtagccgtatcggaaggtgcggctggatcacctccta

SEQ ID NO: 833 - DNA, 1318 bp, Eubacteriaceae bacterium P4P_50 P4
gatgaacgctggcggcgtgcctaacacatgcaagtcgaacgagtggcggacgggtgagtaacacgtaagtaatcaacctataacacacgaataactaatagaaatgttagctaatacgagataaacaaaggcggttatagacgagcttgcgtctgattagctagttggtggggtaagagcctaccaaggcgacgatcagtagccgacctgagagggtgaacggccacattggaactgagagacggtccaaactcctacgggaggcagcagtgggggatattgcacaatggggggaaccctgatgcagcaacgccgcgtgaacgaagaaggccctagggtcgtaaagttctgtcgtatgggaagatgacagtaccatacaagaaagccccggctaactacgtgccagcagccgcggtaatacgtagggggcaagcgttatccggaattactgggcgtaaagggtgcgtaggcggcttgttaagtcaaggttaaaaggcagtagctcaactactgttcggccttgaaactattaagcttgagtataggagaggaaagtggaattcccagtgtagcggtgaaatgcgtagatattgggaggaataccggtggcgaaggcgactttctggactaactgacgctgaggcacgaaagtgtgggtagcaaacaggattagataccctggtagtccacaccgtaaacgatgaacactaggtgtcgggatctcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattaatagttgccagtgcgcaggcactctagtaagacagttagggataacctaaaggaaggtggggatgacgtcaaatcatcatgccccttatgcttagggctacacacgtgctacaatggccgtcaaagagaagcgaatctgtgaagaagagcaaacctgaaacggtccaagttcggatgtaggctgaaactcgcctacagaagtcggagttactagtaatcgcaaatcagaatgttgcggtgaatgcgttcccgggtcttgtacacaccgcccgtcacaccatgggagctgagggcacccaaagtcagtatctaagaagctgcctaaggtgaacttagtaactggggtgaagtcgtaacaaggtagccgta

SEQ ID NO: 834 - DNA, 1527 bp, Eubacterium barkeri
  modified_base (617)..(618): a, c, t, g, unknown or other
  modified_base (1473)..(1473): a, c, t, g, unknown or other
  modified_base (1475)..(1479): a, c, t, g, unknown or other
  modified_base (1488)..(1493): a, c, t, g, unknown or other
  modified_base (1504)..(1512): a, c, t, g, unknown or other
tttaattgagagtttgatcctggctcaggacgaacgctggcggtatgcttaacacatgcaagtcgaacgagaagctttttatggatccttcgggagaaataagagtggaaagtggcgaacgggtgagtaacgcgtgggtaacctgcctcatggaaaggaatagcctcgggaaactgggagtaaagccttatattattaagacatcgcatggtgttttaatgaaaactccggtgccatgagatggacccgcgtcccattagctagttggtgagataacagcccaccaaggcaacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaaactcttttattggggaagaagaagtgacggtacccaatgaagaagtcccggctaactacgtgccagcagccgcggtaatacgtaggggacaagcgttgtccggaatcactgggcgtaaagggcgcgtaggcggttttataagtcagatgtgaaaggtaccggctcaaccggnnacgtgcatttgaaactgtaagacttgagtactggagaggcaagtggaattcctagtgtagcggtgaaatgcgtagatattaggaggaacaccggtggcgaaggcggcttgctggacagatactgacgctgaggtgcgaaagcgtggggagcgaacaggattagataccctggtagtccacgccgtaaacgatgatgactaggtgttggggaaactcagtgccgcagttaacacattaagtcatccgcctggggagtacgaccgcaaggttgaaactcaaaggaattgacggggacccgcacaagcagcggagcatgtggtttaattcgaagcaacgcgaagaaccttaccaggccttgacatcctctgaccatcctagagataggagatttccttcgggaacagagagacaggtggtgcatggttgtcgtcagctcgtgtcgtgagatgttgggttaagtcccgcaacgagcgcaacccttgcctttagttgccagcattaagttgggcactctaaagggactgccgtagacaatacggaggaaggtggggacgacgtcaaatcatcatgccccttatggcctgggctacacacgtgctacaatgggttgggacaaagggaagcgaagccgcgaggtgaagccaatcccataaaacaacccccagttcggattgcaggctgaaacccgcctgcatgaagttggagttgctagtaatcgcagatcagaatgctgcggtgaatgcgttcccgggtcttgtacacaccgcccgtcacaccacgagagttggcaacacccgaagccagtgagcgaaccgcaaggacgcagctgtcgaaggtggggtcagtaattggggngnnnnngtaacaagnnnnnngtatcggaagnnnnnnnnngatcacctcctttct

SEQ ID NO: 835 - DNA, 1538 bp, Eubacterium biforme
tggagagtttgatcctggctcaggatgaacgctggcggcatgcctaatacatgcaagtcgaacgagaggaaggaaagcttgcttttctgaatctagtggcgaacgggtgagtaacacgtaggtaacctgcccatgtgcccgggataacttctggaaacggatgctaaaaccggataggtagcagacaagcatttgactgctattaaagtggctaaggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacgacattcatagggaatgatgagtgagtgatggtatcttaccagaaagtcacggctaactacgtgccagcagccgcggtaatacgtaggtggcgagcgttatccggaatgattgggcgtaaagggtgcgtaggtggcagaacaagtctggagtaaaaggtatgggctcaacccgtactggctctggaaactgttcagctagagaacagaagaggacggcggaactccatgtgtagcggtaaaatgcgtagatatatggaagaacaccggtggcgaaggcggccgtctggtctgttgctgacactgaagcacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttatcaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacctttcgaggagtgagccgtcgaaggcaggaccgatgactggggttaagtcgtaacaaggtatccctacgggaacgtggggatggatcacctcctttct

SEQ ID NO: 836 - DNA, 1438 bp, Eubacterium brachy
gatgaacgctggcggcgtgcttaacacatgcaagtcgagcgagaagttttgaaaagattcttcggatgaaatttaaaatggaaagcggcggacgggtgagtaacgcgtaggcaaccatacaaagggatagcatttggaaacgaatattaataccttatgaaacttaactagtgcatgctaggtaggtcaaagatttatcggtatgggatgggcctgcgtctgactgcccttagctagttggtgaggtaacggctcaccaaggcgacgatcagtagccgacctgagagggtgaacggccacattggaactgagacacggtccaaactcctacgggaggcagcagtggggaatattgcacaatgggggaaaccctgatgcagcaacgccgcgtgaacgatgaaggcctttgggtcgtaaagttctgttctaggtgatgaaaactgacagtaacctaggagaaagccccggctaactccgtgccagcagccgcggtaatactggagggggcaagcgttatccggaattattgggcgtaaagggtacgtaggtggccttttaagcgtagggtataaggcaatggctcaaccattgttcgccctatgaactggaaggcttgagtgcaggagaggaaagcggaattcctagtgtagcggtggaatgcatagatattaggaggaacatcagcggcgaaggcggctttctggactgcaactgacactgaggtacgaaagcgtggggagcaaacaggattagataccctggtagtccacgccgtaaacgatgagcactaggtgtcggggtcgtaaggcttcggtgccgtagttaacgcattaagtgctccgcctggggagtacgcacgcaagtgtgaaactcaaaggaattgacggggacccgcacaagcagcggagcatgtggtttaattcgaagcaacgcgagaaccttaccaggacttgacatccttctgaccggtctttaataggacctttcttttgacagaagagacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggctggtacaaagagaagcaagaccgcaaggtggagcaaagctcaaaaaccagccccagttcggattgtaggctgaaactcgcctacatgaagtcggagttgctagtaatcgcagatcagaatgctgcggtgaatgcgttcccgggtcttgtacacaccgcccgtcacaccatggaagttgggggcgcccaaagttggcagataaatatgctacctaaggtgaaaccaatgactggggtga

SEQ ID NO: 837 - DNA, 1472 bp, Eubacterium budayi
agagtttgatcctggctcaggacgaacgctggcggcgtgcctaacacatgcaagtcgagcgatgaagtttccttcgggaaacggattagcggcggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggcacgataatgacgtacccaaggaggaagccacggctaactacgtgccagcagccgcggtaatacgtaggtgccgaacgttgtccggatttactggccgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaacgtggggagcgaacaggattagataccctggtagtccacgccgtaaacgatgaatactaggtgtaggggtttcaacacctctgtgccgccctaacgcattaagtattccgcctggggagtacggtcgcaagattaaaactcaaaggaattgacgggggcccgcacaagtagcggagcatgtggtttaattcgaagcaacgcgaagaaccttacctagacttgacatcctctgcattacccttaatcggggaagttccttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgcaataccgcgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcaggcagctacctaaggtagggtcagcgattggggtgaagtcgtaacaaggtaacc

SEQ ID NO: 838 - DNA, 1338 bp, Eubacterium callanderi
cttcgggtgacattagaactggaaagtggcgaacgggtgagtaacgcgtgggtaacctgccctatggaaaggaatagcctcgggaaactgggagtaaagccttatattatggttttgtcgcatggcaagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcaaagctctgttattggggaagaagaatgacggtagagaaccgctaactacgtgccagcagccgcggtaatacgtaggggacaagcgtttccggaatgactgggcgtaaagggcgcgtaggcggtctattaagttgatgtgaaaggtaccggctcaaccggtgaagtgcattggaaactggtaacttgagtattggagaggcaagtggaattcctagtgtacggtgaaatgcgtaatattaggaggaacaccagtggcgaaggcggcttgctggacaaatactgacgctgagtgcgaaagcgtggggagcgaacaggatcagataccctggtagtccacgccgtaaacgatgaatgctaggtgttggggaaactcagtgccgcagttaacacaataagcattccgcctggggagtacgaccgccaggttgaaactcaaaggaattgacggggacccgcacaagcagcggagcatgtggtttaattcgaagcaacgcgaagaagcttaccattggtaactggcagacttgagtcttggagagggaaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggacgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagc

SEQ ID NO: 839 - DNA, 1524 bp, Eubacterium cellulosolvens
  modified_base (1492)..(1492): a, c, t, g, unknown or other
tgagtttgatcctggctcaggatgaacgctggcggcgtgcttaacacatgcaagtcgagctaagcactctggaagattccttcgggatgattccttagtgacttagcggcggacgggtgagtaacgcgtgggcaacctgccttgtacagggggataacagttagaaatgactgctaataccgcataagcgcacagcatggcatcatgcagtgtgaaaaactccggtggtacaagatgggcccgcgttggattagcttgttggtggggtaacggcccaccaaggcgacgatccatagccggactgagaggtcgaacggccacattgggactgagacacggcccagactcctacgggaggcagcagtggggaatattgcacaatggaggaaactctgatgcagcgacgccgcgtgagtgatgaagtatttcggtatgtaaagctctatcagcagggaagaaattgacggtacctgactaagaagccccggctaactacgtgccagcagccgcggtaatacgtagggggcaagcgttatccggatttactgggtgtaaagggagcgtagacggcgatgcaagtctgaagtgaaaacctggggctcaaccccaggattgctttggaaactgtattgctagagtaccggaggggtaagcggaattcctagtgtagcggtgaaatgcgtagatattaggaggaacaccggtggcgaaggcggcttactggacggcaactgacgttgaggctcgaaagcgtggggagcaaacaggattagataccctggtagtccacgccgtaaacgatgaatactaggtgtcagcaggcaaagcctgttggtgccgccgctaacgcattaatgtattccacctggggagtacgttcgcaagaatgaaactcaaaggaattgacggggacccgcacaagcggtggagcatgtggtttaattcgaagcaacgcgaagaaccttaccaaatcttgacatccctctgacagatccttaatcggatccttccttcgggacagaggagacaggtggtgcatggttgtcgtcagctcgtgtcgtgagatgttgggttaagtcccgcaacgagcgcaacccttatccttagtagccagcaggtcaagctgggcactctggggagactgccagggagaacctggaggaaggtggggatgacgtcaaatcatcatgccccttatgatttgggctacacacgtgctacaatggcgtgaacagagggaagcgaagccgcgaggcctggcaaatctcaaaaaacacgtcccagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagtctgtgacccaaccgcaaggagggagcagccgaaggcagggccagtaactggggtgaagtcgtaacaaggtanccgtatcggaaggtgccggctggatcaccttt

SEQ ID NO: 840 - DNA, 1362 bp, Eubacterium contortum
cggattgaagagttttgcgactgagcggcggacgggtgagtaacgcgtgggtaacctgcctcatacagggggataacagttagaaatgactgctaataccgcataagaccacggtaccgcatggtaccgtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacagggctagtggaggggtgaagttcgtagacagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggag

SEQ ID NO: 841 - DNA, 1446 bp, Eubacterium coprostanoligenes
gtgtgcctaacacatacaagtcagtcgacgagcttgacgaacgattcttcggatgaattctgatatgactgagtggcggacgggtgagtaacgcgtgagcaacctgcccttcagagggggatagcgtctggaaacggacggtaataccgcataatgtacaatgatggcatcattgatgtaccaaagctattgcgctgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagtgaagaaaaatgacggtagctaaggagcaagccacggctaactacgtgccagcagccgcggtaatacgtaggtggcaagcgttgtccggaattactgggtgtaaagggagcgcaggcgggggagcaagtcagctgtgaaatctatgggcttaacccataaactgcagttgaaactgttcttcttgagtgaagtagaggttggcggaattccgagtgtagcggtgaaatgcgtagatattcggaggaacaccggtggcgaaggcggccaactgggcttttactgacgctgaggctcgaaagtgtggggagcaaacaggattagataccctggtagtccacactgtaaacgatgataactaggtgtagggggtctgaccccttctgtgccgcagctaacgcaataagttatccacctggggagtacgaccgcaaggttgaaactcaaaggaattgacggggacccgcacaagcagtggattatgtggtttaattcgatgcaacgcgaagaaccttaccagcacttgacatccaactaacgaaatagagatatattaggtgcccctcggggaaagttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggatgacgtcaaatcatcatgccccttatgtgctgggctacacacgtaatacaatggtcgttaacaaagagaagcaataccgcgaggtggagcaaaacttcaaaaacgatctcagttcggactgtaggctgaaactcgcctgcacgaagttggaattgctagtaatcgtggatcagcatgccacggtgaatacgttcccgggtcttgtacacaccgcccgtcacaccatgggagccggtaatacccgaagtcagtagtctaaccttaatggaggacgctgccgaaggtaggattggcgactggggtgaagtcgt

SEQ ID NO: 842 - DNA, 1541 bp, Eubacterium cylindroides
tggagagtttgatcctggctcaggatgaacgctggcggcatgcctaatacatgcaagtcgaacggaccgaagggaaagcttgcttttcctgaagtcagtggcgaacgggtgagtaacacgtaggtaacctgcccatgtgcccgggacaacgcctggaaacgggtgctaaaaccggataggtagagagatcgcatgaactttctattaaaggggctacggccctgaacatggatggacctgcggtgcattagctagttggtgaggtaacggcccaccaaggcgacgatgcatagccgacctgagagggcgaacggccacattgggactgagacacggcccaaactcctacgggaggcagcagtagggaattttcgtcaatggggggaaccctgaacgagcaatgccgcgtgagtgaagacggtcttcggattgtaaagctctgttgcgagagaaaaacgacacggatagggaatgatccgtgggtgatggtatctcgccagaaagtcacggctaactacgtgccagcagccgcggtaatacgtaggtggcgagcgttatccggaatgattgggcgtaaagggtgcgtaggcggcccgttaagtctggagtcaaagccggcagctcaactgtcgtacgctttggaaactggcgggctggagtgcagaagagggcgatggaactccatgtgtagcggtaaaatgcgtagatatatggaagaacaccagtggcgaaggcggtcgcctggtctgcaactgacgctgaagcacgaaagcgtggggagcaaataggattagataccctagtagtccacgccgtaaacgatgagaactaagtgttgggggaataactcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccgggcaagggcgtagagatacgccggaggctatcccggtgacaggtggtgcatggttgtcgtcagctcgtgtcgtgagatgttgggttaagtcccgcaacgagcgcaacccttgtgatatgttactaccagtaagatgaggactcatatcagactgccggtgacaaaccggaggaaggtggggatgacgtcaaatcatcatgccccttatggcctgggctacacacgtactacaatggcgcatacaaagagcagcgaacccgtgagggcaggcgaatctcgcaaagtgcgtctcagttcggattgaagtctgcaacccgacttcatgaagttggaatcgctagtaatcgcgaatcagcatgtcgcggtgaatacgttctcgggccttgtacacaccgcccgtcaaaccatgggagttggtaatacccgaagccggtggcataacccattcagggagtgagccgtcgaaggtaggatcgatgactggggttaagtcgtaacaaggtatccctacgggaacgtggggatggatcacctcctttct

SEQ ID NO: 843 - DNA, 1470 bp, Eubacterium desmolans
  modified_base (1)..(1): a, c, t, g, unknown or other
  modified_base (32)..(32): a, c, t, g, unknown or other
  modified_base (275)..(275): a, c, t, g, unknown or other
  modified_base (401)..(401): a, c, t, g, unknown or other
  modified_base (575)..(575): a, c, t, g, unknown or other
  modified_base (580)..(580): a, c, t, g, unknown or other
  modified_base (602)..(602): a, c, t, g, unknown or other
  modified_base (917)..(919): a, c, t, g, unknown or other
  modified_base (957)..(958): a, c, t, g, unknown or other
  modified_base (980)..(980): a, c, t, g, unknown or other
  modified_base (1017)..(1017): a, c, t, g, unknown or other
  modified_base (1026)..(1026): a, c, t, g, unknown or other
  modified_base (1039)..(1039): a, c, t, g, unknown or other
  modified_base (1080)..(1080): a, c, t, g, unknown or other
  modified_base (1180)..(1181): a, c, t, g, unknown or other
  modified_base (1196)..(1196): a, c, t, g, unknown or other
  modified_base (1374)..(1375): a, c, t, g, unknown or other
ntttttagagagtttgatcctggctcaggatnaacgctggcggcgtgcctaacacatgcaagtcgaacggagttattttggaaatctcttcggagatggaattcataacttagtggcggacgggtgagtaacgcgtgagcaatctgcctttaggtgggggataacagtcggaaacggctgctaataccgcataatacgttttgggggcatccttgaaacgtcaaagatttattgcctttagatgagctcgcgtctgattagctggttggcggggnaacggcccaccaaggcgacgatcagtagccggactgagaggttgaacggccacattgggactgagacacggcccagactcctacgggaggcagcagtggggaatattgcgcaatgggggaaacccngacgcagcaacgccgcgtgattgaagaaggccttcgggttgtaaagatctttaatcagggacgaattttgacggtacctgaagaataagctccggctaactacgtgccagcagccgcggtaatacgtagggagcaagcgttatccggatttactgggtgtaaagggcgcgcagncgggncggcaagttgggagtgaaatcngggggcttaacccccgaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgnnngcccgcacaagcagtggagtatgtggtttaattcgaannaacgcgaagaaccttaccaggncttgacatcccggtgaccgtcctagagataggacttnccttcgggncaacggtgacagntggtgcatggttgtcgtcagctcgtgtcgtgagatgttggnttaagtcccgcaacgagcgcaacccttacggttagttgatacgcaagatcactctagccggactgccgttgacaaaacggaggaaggtggggacgacgtnnaatcatcatgccccntatgacctgggctacacacgtactacaatggcagtcatacagagggaagcaaaatcgcgaggtggagcaaatccctaaaagctgtcccagttcagattgcaggctgcaacccgcctgcatgaagtcggaattgctagtaatcgcggatcagcatgccgcggtgaatacgttcccgggnnttgtacacaccgcccgtcacaccatgagagccgtcaatacccgaagtccgtagcctaaccgcaaggggggcgcggccgaaggtaggggtggtaat

SEQ ID NO: 844 - DNA, 1013 bp, Eubacterium dolichum
  modified_base (10)..(10): a, c, t, g, unknown or other
  modified_base (14)..(14): a, c, t, g, unknown or other
  modified_base (49)..(49): a, c, t, g, unknown or other
  modified_base (74)..(76): a, c, t, g, unknown or other
atcgtaaagntctntgtaagagaaaaacgatggatataggaaatgatgnccaagtgatggtatcttaccagaannnacggctaactacgtgccagcagccgcggtaatacgtaggtggcaagcgttatccggaatgattgggcgtaaagggtgcgtaggtggtgcattaagtctgaagtaaaagccagcagctcaactgctgtaagctttggaaactggtgtactagagtgcaggagagggcgatggaattccatgtgtagcggtaaaatgcgtagatatatggaggaacaccagtggcgaaggcggtcgcctggcctgtaactgacactgaggcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcgcatgttaccagcattcagttggggactcatgtgagactgccggtgacaaaccggaggaaggtggggatgacgtcaaatcatcatgccccttatggcctgggctacacacgtactacaatggcgtctacaaagaggagcgacacagtgatgtgaagcaaatctcataaaggacgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgca

SEQ ID NO: 845 - DNA, 1394 bp, Eubacterium eligens
  modified_base (19)..(20): a, c, t, g, unknown or other
  modified_base (44)..(45): a, c, t, g, unknown or other
  modified_base (1382)..(1382): a, c, t, g, unknown or other
tcgaacgaagcatttaggnnacagattatttcggtatgaagttnnttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccttactgcgggtaaagagagtgtcgttgcctagggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgnaagaaggagccg

SEQ ID NO: 846 - DNA, 1319 bp, Eubacterium fissicatena
  modified_base (23)..(23): a, c, t, g, unknown or other
  modified_base (43)..(45): a, c, t, g, unknown or other
  modified_base (887)..(887): a, c, t, g, unknown or other
ggattgaagagtgttgcgacggngcggcggacgggtgagtgannngtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgaatactagtgtcgggtggcaaagccattcggtgccgcagcaaacgcaataagtattccacctggggagtacgttcgcaagaatgaaactcaaaggaattgacggggacccgcacaagcggtggacatgtggtttaattgaagcaacgcgatagggtgcaagcgctntccagaccacactgaccggcgtgtaatggcgccttcccttcggggcagtggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggaggacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccccccgtcacaccatgggagttg

SEQ ID NO: 847 - DNA, 937 bp, Eubacterium hadrum
  modified_base (83)..(83): a, c, t, g, unknown or other
  modified_base (890)..(890): a, c, t, g, unknown or other
  modified_base (903)..(903): a, c, t, g, unknown or other
  modified_base (923)..(923): a, c, t, g, unknown or other
acgaaacaccttatttgattttcttcggaactgaagatttggtgattgagtggcggacgggtgagtaacgcgtgggtaacctnccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaaagtattccacctggggagtacgttcgcaagaatgaaactcaaaggaattgacggggacccgcacaagcggtggagcatgtggtttaattcnaagcaacgcgaanaaccttacctggtcttgacntccttctgaccggt

SEQ ID NO: 848 - DNA, 1342 bp, Eubacterium hallii
caccttttgagattcttcggatgatcgattggtgactgagtggcggacgggtgagtaacgcgtgggtaacctgccctgtacagggggataacagctggaaacggctgctaataccgcataagcgcacgaggagacatctcctagtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtcacgccgtaaacgatgaatactaggtgtcggggccgtataggcttcggtgccgccgcaacgcagtaagtattccacctggggagtacgttggcaagaatgaaactcaaaggaattgacggggacccgcacaagcggtggagcatgtggtttaattcgaagcaacgcgaagaagcttaccaggtcttgacatccttgtgaccgcaccttaatcggggctttccttcgggacagaagagacaggtggtgcatggttgttgtcagctcgtgtcgtgagatgttgggttaagtcccgcaacgagcgcaacccctattttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtttgcaacccgactacccgaagctggaatcgctagtaatcgcgaatcagaatgtcgcggtgaatacgttcccgggttttgtaccccccccccgtcacaccctgggagttggaaat

SEQ ID NO: 849 - DNA, 1494 bp, Eubacterium infirmum
gatgaacgctggcggcgtgcctaacacatgcaagtcgagcgagaagtaaagaaatgaagcttcggtagatttcattatggaaagcggcggacgggtgagtaacgcgtaggcaacctgccctgtacagggggatagccacccgaaaaggtgattaataccccatgatgcaagagatacacatgtatcacttgtcaaagatttatcggtatgggatgggcctgcgtctgattagctagttggtagggtaacggcttaccaaggcaacgatcagtagccgacctgagagggtgatcggccacattggaactgagacacggtccaaactcctacgggaggcagcagtggggaatattgcacaatgggggaaaccctgatgcagcaacgccgcgtgaaggaagaaggccttcgggttgtaaacttctgtcctaggggaagaaacaaatgacattacccttggaggaagccccggctaactacgtgccagcagccgcgggtaatacgtagggggcgagcgttatccggaattattgggcgtaaagagtgcgtaggtggcatcttaagcgcagggtttaaggcaatggctcaaccattgttcgccttgcgaactggggtgcttgagtgcaggaggggaaagtggaattcctagtgtagcggtgaaatgcgtagatattaggaggaacaccagtggcgaaggcgactttctggactgttactgacactgaggcacgaaagcgtggggagcaaacaggattagataccctggtagtccacgccgtaaacgatgagcactaggtgtcggggtcgcaagacttcggtgccgcagttaacgcattaagtgctccgcctgggaagtacgcacgcaagtgtaaaactcaaaggaattgacggggacccgcacaagcagcggagcatgtggtttaattcgaagcaacgcgaagaaccttaccaggaacttgacatcctcttgacagatccttaatcggattcttcttcggacaagagagacaggtggtgcatggttgtcgtcagctcgtgtcgtgagatgttgggttaagtcccgcaacgagcgcaacccttgccattagttgccatcatttagttgggcactctagtgggactgccggggaaaactcggaggaaggtggggatgacgtcaaatcatcatgccccttatgttctgggctacacacgtgctacaatggccggtacaacaggcagcgaacccgtgagggggagcgaatcccaaaagccggtcccagttcggactgtaggctgcaactcgcctacacgaagttggagttgctagtaatcgcggatcagaatgccgcggtgaatgcgttcccgggtcttgtacacaccgcccgtcacaccatggaagttgggggtgcccgaagtcggttatttaatctatcgcctaaggcaaaaccaatgactggggtgaagtcgtaaccaaggtagcccgtatcggaaggtgccggctggatcacctcctta

SEQ ID NO: 850 - DNA, 1377 bp, Eubacterium limosum
  modified_base (1310)..(1310): a, c, t, g, unknown or other
gaacgagaagatcagttaagaaccttcgggggaataagtgattggaaagtggcgaacgggtgagtaacgcgtgggtaacctgccctatggaaaggaatagcctcgggaaactgggagtaaagccttatattatggagagatcgcatggtcatttcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctgataagtcagatgtgaaaggtaccggctcaaccggtgacgtgcatttgaaactgtcagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacgtcctctgacaatcccagagatgggacgtttccttcgggaacagagagacaggtggtgcatggttgtcgtcagctcgtgtcgtgagatgttgggttaagtcccgcaacgagcgcaacccctgcctttagttgccagcattgagttgggcactctagagggactgccgtagacaatacggaggaaggtggggatgacgtcaaatcatcatgccctttatgacctgggctacacacgtgctacaatggtctgatcagagggccgcgaaaccgcgaggtgaagcaaatcccttaaaacagatcccagttcggattgcaggctgcaattcgcctgcatgaagttggagttgctagtaatcgcggatcagaatgccgcggtgaatgcgttcccgggtctngtacacaccgcccgtcacaccacgagagttggcaacacccgaagcctgtgagagaaccgcaaggact

SEQ ID NO: 851 - DNA, 1488 bp, Eubacterium moniliforme
gacgaacgctggcggcgtgcctaacacatgcaagtcgagcgatgaartttccttcgggaaatggattagcggcggacgggtgagtaacacgtgggtaacctgccttgtagaggggaatagccttccgaaaggaagattaataccgcataatattgtactttcgcatgaaagaacaattaaaggagcaatccgctacaagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcgagcgttgtccggatttactgggcgtaaagggagcgtaggcggattcttaagtgggatgtgaaatactcgggcttaacctgagtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttcaacacctctgtgccgccgctaacgcattaagtattccgcctggggagtacggtcgcaagattaaaactcaaaggaattgacgggggcccgcacaagtagcggagcatgtggtttaattcgaagcaacgcgaagaaccttacctagacttgacatcttctgcattacccttaatcggggaagttccttcgggaacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgaggtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctccttt

SEQ ID NO: 852 - DNA, 1471 bp, Eubacterium multiforme
agagtttgatcctggctcaggacgaacgctggcggcgtgcctaacacatgcaagtcgagcgatgaagtttcttcgggaaacggattagcggcggacgggtgagtaacacgtgggtaacctgccttgtagagggaaatagccttccgaaaggaagattaataccgcataatattgtaccttcgcatgaaggaacaattaaaggagcaatccgctacaagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggacgataatgacgtacccaagaaggaagccacggctaactacgtgccagcagccgcggtaatacgtaggtggcgagcgttgtccggatttactgggcgtaaagggagcgtaggcggattcttaagtgggatgtgaaatactcgggctcaacctgagtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtaggggtttaaacacctctgtgccgccctaacgcattaagtattccgcctgggagtacggtcgcaagattaaaactcaaagaaattgacgggggcccgcacaagtagcggagcatgtggtttaattcgaagcaacgcgaagaaccttacctagacttgacatcttctgcattacccttaatcggggaagttcttcgggaacagaatgacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacagagagatgcaataccgtgagtggagctaaacttcaaaacttgtctcagttcggattgtaggctgaaactcgcctacatgaagctggagttactagtaatcgcgaatcagcatgtcgcggtgaatacgttcccgggccttgtacacaccgcccgtcacaccatgagagttggcaatacccaaagttcgtgagctaacgcgtaagcaggggcagccacctaaggtagggtcagccatttgggtgaagtcgttaacaaggtaacc

SEQ ID NO: 853 - DNA, 1477 bp, Eubacterium nitritogenes
agagtttgatcctggctcaggacgaacgctggcggcgtgcctaacacatgcaagtcgagcgatgaagtttccttcgggaaacggattaccgccggacgggtgagtaacacgtgggtaacctgcctcatagaggggaatagcctcccgaaagggagattaataccgcataacattgcagtttcgcatgaaacagcaattaaaggagcaatccgctatgagatggacccgcggcgcattagctagttggtaaggtaatggcttaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttgggacgataatgacgtacccaaggaggaagccacggctaactacgtgccagcagccgcggtaatacgtaggtggcgagcgttgtccggatttactgggcgtaaagggagcgtaggcggatttttaagtgggatgtgaaatacccgggctcaacctgggtgctgcattccaaactgggaatctagagtgcaggaggggagagtggaattcctagtgtagcggtgaaatgcgtagagattaggaagaacaccagtggcgaaggcgactctctggactgtaactgacgctgaggctcgaaagcgtggggagcgaacaggattagataccctggtagtccacgccgtaaacgataaatactaggtgtaggggtttaaacacctctgtgccgccctaacgcattaagtatcccgcctgggaagtacggtcgcaagattaaaactcaaaggaattgacgggggcccgcacaagtagcggagcatgtggtttaattcgaagcaacgcgaagaaccttacctagacttgacatcctctgcattacccttaatcggggaagttcttcgggaacagagtgacaggtggtgcatggttgtcgtcagctcgtgtcgtgagatgttgggttaagtcccgcaacgagcgcaacccctattgttagttgctaccattaagttgagcactctagcgagactgcctgggttaaccaggaggaaggtggggatgacgtcaaatcatcatgccccttatgtctagggctacacacgtgctacaatggcaagtacagagagatgcaataccgcgaggtggagctaaacttcaaaactcgtctcagttcggattgtaggctgaaactcgcctacatgaagctggagttactagtaatccgcgaatcagcatgtcgcggtgaatacgttcccgggccttgtacacaccgcccgtcacaccatgagagttggcaatacccaaagttcgtgagctaacgcgtaagcaggggcagccacctaaggtagggttcagccatttggcctgaagtgcgtaacaaggtaacc

SEQ ID NO: 854 - DNA, 1351 bp, Eubacterium nodatum
gatgaacgctggcggcgtgcctaacacatgcaagttgagcgagaaatcacttaaagaagcttcggtagacttaagagatggagagcagcggacgggtgaggaacgcgtgggaaacctgcccttgacaggaggatagccgagagaaatttcgatttaatacttcataaagcagagcattcgcatggatgaactgccaaagaattatcggtcaaggatggtccagcgtctgattagctggttggtaaggtaccggcttaccaaggcgacgatcagtagccggcctgagagggtgaacggccacattggaactgagacacggtccagactctacgggaggcagcagtggggaatattgcacaatgggcgaagcctgatgcagcaacgccgcgtgaaggaagaaggctttcgagtcgtaaacttctgtccaaagggaagaataatgacggtacctttgaagaaagccccggctaactacgtgccagcagccgcggtaatacgtagggggcgagcgttatccggaattactgggcgtaaagagtatgtaggtggttaagtaagcgtagggtttaaggcgacagcccaactgtcgtatgccccgcgagctgtttaacttgagtacaggaggggaaggcggaattcctagtgtagcgctgaaatgcgtagatattaggaggaacaccagtggcgaaggcggccttctggactgtaactgacactgagatacgaaagcgtgggtagcaaacaggattagataccctggtagtccacgccgtaaacgatgagcactaggtgtcgggctcgcaagagttcggtgccggagcaaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatcccactgaaagctcggttaaaactgagcccttcttcggaacagtggagacaggtggtgcatggttgtcgtcagctcgtgtcgtgagatgttgggttaagtcccgcaacgagcgcaacccttgccgttagttgccatcattaagttgggcactctaatgggactgccggggagaacccggaggaaggcggggatgacgtcaaatcatcatgccccttatgttctgggctacacacgtgctacaatggccgtcacagagggaagcgagagagcgatcttaagcgaaaccaaaaaggcggtcccagttcggactgcaggctgcaactcgcctgcacgaagccggagttgctagtaatcgcggatcagaatgtcgcggtgaatgcgttcccgggtcttg

SEQ ID NO: 855 - DNA, 1386 bp, Eubacterium ramulus
  modified_base (1339)..(1339): a, c, t, g, unknown or other
gcactttacctgatttccttcggggatgattgttctgtgactgagtggcggacgggtgagtaacgcgtggataacctgcctcacacagggggataacagttggaaacggctgctaataccgcataagcgcacagcaccgcatggtgcagtgtgaaaaactccggtggtgtgagatggatccgcgtctgattagcttgttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagataatgacggtacctgactaagaagctccggctaaatacgtgccagcagccgcggtaatacgtatggagcaagcgttatccggatttactgggtgtaaagggagcgtaggcggtcctgcaagtctgatgtgaaaggccggggctcaaccccgggactgcattggaaactgtaggactagagtgtcggaggggtaagtggaattcctagtgtagcggtgaaatgcgtagatattaggaggaacaccagtggcgaaggcggcttactggacgactactgacgctgaggctcgaaagcgtggggagcaaacaggattagataccctggtagtccacgccgtaaacgatgaatactaggtgttggcaggtaagacctgtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacctcccggtgacagatgaaagaccgggttttcccttcggggcaccggtgacaggtggtgcatggttgtcgtcagctcgtgtcgtgagatgttgggttaagtcccgcaacgagcgcaacccttatccccagtagccagcatttcggatgggcactctgtggagactgccagggacaacctggaggaaggtggggatgacgtcaaatcatcatgccccttatgacttgggctacacacgtgctacaatggcgtaaacaaagggaagcgagaccgcgaggtggagcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatgggnagtcggaaatgcccgaagccggtggcctaaccgcaaggaaggagccg

SEQ ID NO: 856 - DNA, 1387 bp, Eubacterium rectale
tcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtccggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaa

SEQ ID NO: 857 - DNA, 929 bp, Eubacterium ruminantium
  modified_base (12)..(15): a, c, t, g, unknown or other
  modified_base (36)..(36): a, c, t, g, unknown or other
tcgaacgaagannnnctggagtgcttgcacttgganggactgagtggcggacgggtgagtaacgcgtgggtaacctgccttatacagggggataacagttggaaacgactgctaataccgcataagcgcacggtatcgcatgatacagtgtgaaaaactccggtggtataagatggacccgcgtctgattagcttgttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaaactctatcagcagggaagataatgacggtacctgactaagaagcaccggctaaatacgtgccagcagccgcggtaatacgtatggtgcaagcgttatccggatttactgggtgtaaagggtgcgtaggtggtatggcaagtcagaagtgaaaggctggggctcaaccccgggactgcttttgaaactgtcaaactagagtacaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcgggcagcatagctgttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatcccgatgaccgc

SEQ ID NO: 858 - DNA, 1384 bp, Eubacterium saburreum
  modified_base (17)..(18): a, c, t, g, unknown or other
  modified_base (1375)..(1375): a, c, t, g, unknown or other
tcgaacgaagctgttannaggaagtcttcggatggaattttaacagacttagtggcggacgggtgagtaacgcgtggataacctgccttatacagggggataacggagagaaatttccgctaagaccgcataagaccacagcaccgcatggtgcaggggtaaaatattaataggtataagatggatccgcgtccgattagcttgttggtgaggtagaggctcaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggccaagcaagtctgaagtgaaatgcatgggctcaacccatgaattgctttggaaactgttggcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggggagataaactcttcggtgccgcaagcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagttttgtaatgagactagtctttcgggacaagggatacaggtggtgcatggttgtcgtcagctcgtgtcgtgagatgttgggttaagtcccgcaacgagcgcaacccttgtcgtcagtagccagcagtaagatgggcactctgacgagacagccggagataatccggaggaaggtggggatgacgtcaaatcatcatgccccttatgatttgggctacacacgtgctacaatggcgtaaacaaagtgaagcaagaccgcgaggttaagcaaatcacagaaataacgtctcagttcggattgtagtctgcaactcgactatatgaagccggaatcgctagtaatcgcagatcagaatgctgcggtgaatacgttcccgggtcttgtacacaccgcccgtcacaccatgggagtcatcaatgcccgaagtcagtgacctanccgtaagga

SEQ ID NO: 859 - DNA, 1343 bp, Eubacterium saphenum
gatgaacgctggcggcgtgcttaacacatgcaagtcgagcgagaaactacatgcagacacttcggtagaagcgagtagcggaaagcggcggacgggtgagtaacgcgtggcaacctgcccttcacagaggtatagcctcgggaaaccgggattaaaaccacataaaatcataggttcgcatgaaccaaaggtcaaagatttatcggtgaaggatgggcctgcgtctgattagctggttggtagggtaaaagcctaccaaggcgacgatcagtagccgacctgagagggtgatcggccacattggaactgagacacggtccaaactctacgggaggcagcagtgggggatattgcacaatgggggaaaccctgatgcagcaacgccgcgtgaggtatgaaggcctttgggttgtaagcctctgtcctaggggaagaaaaaaatgacggtacccgaggaggaagccccggctaactacgtgccagcagccgcggtaatacgtagggggcaagcgttatccggaattattgggcgtaaagagtgcgtaggtggtctactaagcgcggggtgaaaggcaatggctcaaccattgttagccttgcgaactggcagacttgagtgcaagagaggaaagcggaattcctagtgtagcggtgaaatgcgcagatattaggaggaacaccggcggcgaaggcggctttctggattgtaactgacactgaggcacgaaagcgtgggtagcaaacaggattagataccctggtagtccacgccgtaaacgacgagcactaggtgtcgggacatgagtctcggtgccgcagttaacgcaataagtgtccgcctggggagtacgcacgcaagtgtaaaactcaaaggaattgacggggacctgcgcaagcagcggagcatgtggtttaattcgaagcaacgcgaagaaccttaccaagacttgacatccctctgacgtacccttaatcgggtatttcttcggacagaggagacaggtggtgcatggttgtcgtcagctcgtgtcgtgagatgttgggttaagtcccgcaacgagcgcaacccttgtctttagttgccatcattaagttgggcactctaaagagactgccggggaaactcggaggaaggtggggatgacgtcaaatcatcatgccccttatgtcttgggctacacacgtgctacaatggccggtacaaagagaagcgataccgcaagggggagcaaatcttaaaaaccggtcccagttcggattgcaggctgcaactcgcctgcatgaagtcggagttgctagtaatcgcagatcagaatgctgcggtgaatgcgttcccgggtctt

SEQ ID NO: 860 - DNA, 1368 bp, Eubacterium siraeum
  modified_base (901)..(901): a, c, t, g, unknown or other
gtcgaacggtgaagaggagcttgctcctcggaacagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccagtnataagtgaaaattaccggctcaactcgtaagcttttccttaaggggacataattgagggaggtagaggcaagcggaaagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgc

SEQ ID NO: 861 - DNA, 965 bp, Eubacterium sp. 3_1_31
  modified_base (39)..(39): a, c, t, g, unknown or other
  modified_base (41)..(41): a, c, t, g, unknown or other
  modified_base (842)..(842): a, c, t, g, unknown or other
  modified_base (875)..(875): a, c, t, g, unknown or other
  modified_base (904)..(904): a, c, t, g, unknown or other
  modified_base (915)..(915): a, c, t, g, unknown or other
  modified_base (934)..(934): a, c, t, g, unknown or other
tttaggaagcttgcttccaaagagacttagtggcgaacngntgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcanaggaattgacgggggcccgcacaagcggtggantatgtggtttaattcgaagcaacgcgaanaaccttaccangccttgacatggatataantgttctagagatagaaagatagctatatatc

SEQ ID NO: 862 - DNA, 1229 bp, Eubacterium sp. AS15b
tgagtttgatcctggctcaggatgaacgctggcggcgtgcctaacacatgcaagtcgaacgagtggcggacgggtgagtaacgcgtaagtaatcaacctgtgacacacggataactgatagaaatgtcagctaatacgagatgaacaaaggcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtggcggtgaaatgcgtagatatcgggaggaataccggtggcgaaggcgactttctggactaactgacgctgaggcacgaaagcgtgggtagcaaacaggattagataccctggtagtccacgccgtaaacgatgaacactaggtgtcgggatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattgatagttgccagtgcgtaggcactctatcaagacagttatggataacataaaggaaggtggggatgacgtcaaatcatcatgccccttatgcttagggctacacacgtgctacaatggctgtcaaagagaagcaaggtcgcaaggcggagcaaacctgaagcagtccaagttcggatgtgggctgaaactcgcccacagaagtcggagttactagtaatcgcgaatcagaatgtcgcggtgaatgcgttcccgggtcttgt

SEQ ID NO: 863 - DNA, 1253 bp, Eubacterium sp. OBRC9
  modified_base (1234)..(1234): a, c, t, g, unknown or other
agtggcggacgggtgagtaacgcgtaagtaatcaacctgtgacacacggataactgatagaaatgtcagctaatacgagatgaacaaaggcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtggctcaactactgttgggccttgaaactaattagcttgagtataggagaggaaagtggaattcccggtgtagcggtgaaatgcgtagatatcgggaggaataccggtggcgaaggcgactttctggactaactgacgctgaggcacgaaagcgtgggtagcaaacaggattagataccctggtagtccacgccgtaaacgatgaacactaggtgtcgggatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatgcacaggtggtgcatggttgtcgtcagctcgtgtcgtgagatgttgggttaagtcccgcaacgagcgcaacccctattgatagttgccagtacgtaggcactctattaagacagttatggataacataaaggaaggtggggatgacgtcaaatcatcatgccccttatgcttagggctacacacgtgctacaatggctgtcaaagagaagcaaggtcgtaaggcggagcaaacctgaagcagtccaagttcggatgtgggctgaaactcgcccacagaagtcggagttactagtaatcgcgaatcagaatgtcgcggtgaatgcgttcccgggtcttgtacacaccgcccgtcacaccatgggagctgagggtacccaaagtcagtatctaagaagctgcctaangtaaacttagtgactgggg

SEQ ID NO: 864 - DNA, 1371 bp, Eubacterium sp. WAL 14571
  modified_base (925)..(925): a, c, t, g, unknown or other
  modified_base (1268)..(1268): a, c, t, g, unknown or other
tcgagcgagaagccattgactgaaacttcggtagaaggatatggtggaaagcggcggacgggtgagtaacgcgtaggcaacctgccccttacagagggatagccattggaaacgatgattaaaacctcataacgcatcccccccacatggaggggaagccaaagattcatcggtaagggatgggcctgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagggatgaaggccttcgggtcgtaaacctctgtccttggggaagaaacaaatgacggtacccatggaggaagccccggctaactacgtgccagcagccgcggtaatacgtagggggcgagcgttatccggaattattgggcgtaaagagtgcgtaggtggttacctaagcgcagggtctaaggcaatggctcaaccattgttcgccctgcgaactgggctacttgagtgcaggagaggaaagcggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgagcactaggtgtcggggccgcaaggcttcggtgccgcagttaacgcattaagtgctccgcctggggagtacgcacgcaagtgtgaaactcaaaggaattgacggggacccgcacaagcagcggagcatgtggtttaattcgaagcaacgcgaagaagcttaaccagtgttcgccntccgaactgggctacctaaccggatccttcttcggacagtggagacaggtggtgcatggttgtcgtcagctcgtgtcgtgagatgttgggttaagtcccgcaacgagcgcaacccttgccattagttgccatcattcagttgggcactctaatgggactgccggggacaactcggaggaaggtggggatgacgtcaaatcatcatgccccttatgttctgggctacacacgtgctacaatggccggtacagcaagaagcaaaaccgcgaggtggagcaaatctcaaaaaccggtcccagttcggactgcaggctgaaacccgcctgcacgaagccggagttgntagtaatcgtggatcagaatgccacggtgaatgcgttcccgggtcttgtacacaccgcccgtcacaccatggaagttgggggtgcccgaagccggcagggaaa

SEQ ID NO: 865 - DNA, 1363 bp, Eubacterium sp. oral clone GI038
gagtttgattctggctcaggatgaacgctggcggcgtgcctaacacatgcaagtcgaacgagtggcggacgggtgagtaacgcgtgggcaacctgccccataccgggggatagcagttggaaacggctggtaaaaccgcataagaaaaagtggtatgggatgggcccgcgtctgattagccagttggtgaggtaacggctcaccaaagcgacgatcagtagccggcctgagagggcggacggccacattgggactgagacacggcccagactcctacgggaggcagcagtgggggatattgcacaatggaggaaactctgatgcagcgacgccgcgtgagtgaagaagtatttcggtatgtaaagctctatcagcagggaagatgacggtacctgagtaagaagctccggctaaatacgtgccagcagccgcggtaatacgtatggagcaagcgttatccggatttactgggtgtaaagggagcgcagacggatatgcaagtctgaagtgaaaccccacggctcaaccgtgggcttgctttggaaactgtagatctagagtactggagaggtaagcggaattcctggtgtagcggtgaaatgcgtagatatcaggaagaacatcggcggcgaaggcggcttactggacagactgacgttgaggctcgaaggcgtggggagcaaacaggattagataccctggtagcccacgcggtaaacgatgaatactaggtgttgggatttcagtgccgaagcaaacgtgataagtattccacctggggagtacgttcgcaagaatgaaactcaaaggaattgacggggacccgcacaagcggtggagcatgtggtttaattcgaagcaacgcgaagaaccttaccagaccttgaatcgacaggtggtgcatggttgtcgtcagctcgtgtcgtgagatgttgggttaagtcccgcaacgagcgcaacccttgcgtatagtagccagcaattgggaactctatacggactgccggggataacccggaggaaggtggggatgacgtcaaatcatcatgccccttatggtctgggctacacacgtgctacaatgtcgcagagggaagcgaaagggtgacctgaagcgaatctcaaaacgacccagttcggatgcaggctgcaacccgcctgcagaagctggaatcgctagtaatcgcgaatcagcatgtcgcggtgaatacgttcccgggtcttgtacacaccgcccgtcacaccatgggagtcgggaatgcccgaagccggtacctaaggagccgtcgaaggcaggccggatgactggggtgaagtcgtaacaaggtagccgtaggagaacctgcggctggaacacctcctt

SEQ ID NO: 866 - DNA, 1364 bp, Eubacterium sp. oral clone IR009
gagtttgatcctggctcaggatgaacgcgggcggcatgcttaacacatgcaagtcgaacgagtggcggacgggtgagtaacgcgtggataacctgccttatacagggggataacggagagaaatttccgctaagaccgcataagaaaattaggtataagatggatccgcgtccgattagcttgttggtgaggtagaggctcaccaaggcgacgatcggtagccggcccgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcagacggccaagcaagtctgaagtgaaatgcatgggctcaacccatgaattgctttggaaactgttaggcttgagtgtcggaggggtaagcggaattcctagtgtagcggtgaaatgcgtagatattaggaggaacaccggaggcgaaggcggcttactggacgaactgacgttgaggctcgaaggcgtggggagcaaacaggattagataccctggtagtccacgcagtaaacgatgaatacttggtgtcggggcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatatacaggtggtgcatggttgtcgtcagctcgtgtcgtgagatgttgggttaagtcccgcaacgagcgcaacccttgtcgtcagtagccagcatgggaactctgacgagacagccggagataatccggaggaaggtggggatgacgtcaaatcatcatgccccttatgatttgggctacacacatgctacaatggcgtacaaagtgaagcaagaccgcgaggttaagcaaatcacagaacgtctcagttcggatgtagtctgcaactcgactatagaagccggaatcgctagtaatcgcagatcagaatgctgcggtgaatacgttcccgggtcttgtacacaccgcccgtcacaccatgggagtcatcaatgcccgaagtcagtacctaaggagctgccgaaggcagggaggataactggggtgaagtcgtaacaaggtagccgtatcggaaggtgcggttggatcacctcctt

SEQ ID NO: 867 - DNA, 1360 bp, Eubacterium sp. oral clone JH012
ggagtttgatcctggctcaggaggaacgctggcggcgtgcctaacacatgcaagtcgagcgagcggcggacgggtgagtaacgcgtaggcaacctgccctttgcacagggatagcctcgggaaaccgggattaaaacctgataatcaaattaggcaaaggatgggcctgcgtctgattagcttgttggtgaggtaacggctcaccaaggcgacgatcagtagccgacctgagagggtaaacggccacattggaactgagacacggtccaaactcctacgggaggcagcagtggggaatattgcacaatgggcgaaagcctgatgcagcaacgccgcgtgagtgaagaaggcccttgggtcgtaaaactctgttgagagggaagatgacggtacctcttgaggaagccccggctaactacgtgccagcagccgcggtaatacgtagggggcgagcgttatccggaattattgggcgtaaagagtgcgtaggtggttatctaagcgtggggtgaaaggcagtggcttaaccattgtaagccttgcgaactggatagcttgagtgcaggaggggaaagtggaattcctagtgtagcggtgaaatgcgtagatattaggaggaacaccggtggcgaaggcggctttctggactgactgacactgaggcacgaaagcgtgggtagcaaacaggattagataccctggtagtccacgccgtaaacgatgagcactaggtgttggggcctcagtgccgcagttaacgcaataagtgctccgcctggggagtacgcacgcaagtgtaaaactcaaaggaattgacggggacccgcacaagcagcggagcatgtggtttaattcgaagcaacgcgaagaaccttaccaggacttgacatcgacaggtggtgcatggttgtcgtcagctcgtgtcgtgagatgttgggttaagtcccgcaacgagcgcaacccttgtcaatagttgccagcatgggcactctattgagactgccgtggataacacggaggaaggtggggatgacgtcaaatcatcatgccccttatgttttgggctacacacgtgctacaatggccggcaacgagaagcaagaccgcaaggtggagcaaaacttaaccggtcccagttcggatgtaggctgcaactcgcctacagaagatggagttgctagtaatcgcagatcagaatgctgcggtgaatgcgttcccgggtcttgtacacaccgcccgtcacaccatggaagttgggggtgcccgaagtcggttaggagctgccgaaggcaaaaccaatgactggggtgaagtcgtaacaaggtagccgtatcggaaggtgcggctggatcacctcctt

SEQ ID NO: 868 - DNA, 1365 bp, Eubacterium sp. oral clone JI012
ggagtttgattctggctcaggatgaacgctggcggcgtgcttaacacatgcaagtcgaacgagtggcggacgggtgagtaacgcgtgggcaacctgccttatacagggggataacagagagaaatttccgctaataccccataagaaaagttggtataagatggacccgcgtctgattagctggttggtgaggtaaaggctcaccaaggcgacgatcagtagccggcctgagagggtgaacggccacattgggactgagacacggcccaaactcctacgggaggcagcagtggggaatattggacaatggggggaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgtagacggtactgcaagtctggagtgaaacccgcgggctcaacctgcggcatgctttggaaactgtggtactggagtgtcggagaggtaagcggaattcccagtgtagcggtgaaatgcgtagatattgggaagaacacctggggcgaaggcggcttactggacgaactgacgttgaggctcgaaggcgtggggagcaaacaggattagataccctggtagtccacgcagtaaacgatgaatactaggtgtcgggatttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccttgtgatcagtagccagcatggggactctgatcagacagccggagataatccggaggaaggtggggatgacgtcaaatcatcatgccccttatgatttgggctacacacgtgctacaatggcggacaaagagaagcgagtgtgcgaacataagcaaacctcaagccgtctcagttcggatgtagtctgcaactcgactatagaagctggaatcgctagtaatcgcaaatcagaatgttgcggtgaatacgttcccgggtcttgtacacaccgcccgtcacaccatgggagtcatcaatgcccgaagtcagtacctaaggagctgccgaaggcagggaggataactggggtgaagtcgtaacaaggtagccgtatcggaaggtgcggctggatcacctcctt

SEQ ID NO: 869 - DNA, 1364 bp, Eubacterium sp. oral clone JN088
gagtttgattctggctcaggatgaacgctggcggcgtgcctaacacatgcaagtcgaacgagtggcggacgggtgagtaacacgtgggtaacctgccttatggagggggataacagagagaaatcactgctaataccgcataagaaaagtcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacagtacctgactaataagccccggctaactacgtgccagcagccgcggtaatacgtatggggcgagcgttatccggatttactgggtgtaaagggagcgtagacggaatggcaagtctgaagtgaaatacccgggctcaacctggggactgctttggaaactgttgttctacagtgttggagaggtaagtggaattcctggtgtagcggtgaaatgcgtatatatcaagaagaacaccggaggcgaaggcggcttactggacaaactgacgttgaggctcgaaagcgtggggatcaaacaggattagataccctggtattccacgctgtaaacgatgaatactaggtgtcggggtctcggtgccgtcgctaacgcaataagtattccacctggggagtacgttcgcaagaatgaaactcataggaattgacggggacccgcacaagcggtggagcatgtggtttaattcgaagcaacgcgaagaaccttaccaagtcttgagatcgacaggtggtgcatggttgtcgtcagctcgtgtcgtgagatgttgggttaagtcccgcaacgagcgcaacccctatagttagtatccagcatgggcactctaactagactgccagggataacctggaggaaggcggggatgacgtccaatcatcatgccccttatgacttgggctacacacgtgctacaatggcgtacaaagggaagcgagagggtgaccttaagcaaatctcaaaacgtctcagttcggatgtagtctgcaacccgactacagaagctggaatcgctagtaatcgcagatcagcatgctgcggtgaatacgttcccgggtcttgtacacaccgcccgtcacaccatgggagttggtaatgcccgaagtcagttcccagggagctgccgaaggcaggactgatgactggggtgaagtcataacaaggtagccgtatcggaaggtgcggctggatcacctcctt

SEQ ID NO: 870 - DNA, 1354 bp, Eubacterium sp. oral clone JS001
ggagtttgatcctggctcaggatgaacgctggcggcgtgcctaacacatgcaagtcgagcgagcggcggacgggtgagtaacgcgtaggcaacctacccttcacccagggacagcctccggaaacggggattaatacctgatgaccaaagttggtgagggatgggcctgcgtctgattagttagttggtgaggtaacggctcaccaaggcgacgatcagtagccgacctgagagggtgaccggccacattggaactgagacacggtccagactcctgcgggaggcagcagtggggaatattgcacaatgggcgaaagcctgatgcagcaacgccgcgtgaaggatgaaggtccttggattgtaaacttctgtccatagggaagatgacggtacctatggaggaagccccggctaactacgtgccagcagccgcggtaatacgtagggggcaagcgttatccggaattattgggcgtaaagcgtgcgtaggcggctttttaagcgtggggtttaaggctatggctcaaccatagtatgccctgcgaactggaaggcttgagtacaggagaggaaagcggaattcctagtgtagcggtgaaatgcgtagatattaggaggaacaccagtggcgaaggcggctttctggactgactgacgctgaggtacgaaagcgtggggagcaaacaggattagataccctggtagtccacgctgtaaacgatgagcactaggtgtcggggcttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccaggacttgacatcgacaggtggtgcatggttgtcgtcagctcgtgtcgtgagatgttgggttaagtcccgcaacgagcgcaacccttgttactagttgccatcatgggcactctagtgagactgccggggacaactcggaggaaggtggggatgacgtcaaatcatcatgccccttatgttctgggctacacacgtgctacaatggctggcaaagagaagcgagaccgtgaggtggagcaaaactcaccagccccagttcggatgcaggctgcaactcgcctgcagaagccggagttgctagtaatcgcagatcagaatgctgcggtgaatgcgttcccgggtcttgtacacaccgcccgtcacaccatggaagttgggggcgcccgaagttggtattacctaaggcgaaaccgatgactggggtgaagtcgtaacaaggtagccgtaggagaacctgcggctggatcacctcctt

SEQ ID NO: 871 - DNA, 1427 bp, Eubacterium sp. oral clone OH3A
  modified_base (11)..(11): a, c, t, g, unknown or other
tcgacgaaggnatatataggaagtcttcggatggaatatgtataacttagtggcggacgggtgagtaacgcgtaagtaatcaacctgtgacacacggataactgatagaaatgtcagctaatacgagatgaactgtttaaattgggaaatggaaacagcaaagcgaaagcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagaaacaaatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtagcggtgaaatgcgtagatatcgggaggaataccggtggcgaaggcgactttctggactataactgacgctgaggcacgaaagcgtgggtagcaaacaggattagataccctggtagtccacgccgtaaacgatgaacactaggtgtcgggaggaatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatggggatgaaaagcaatgtaaagttgtaatgatactttcgggtatacatcccacacaggtggtgcatggttgtcgtcagctcgtgtcgtgagatgttgggttaagtcccgcaacgagcgcaacccctattgatagttgccagtgcgttaagataggcactctatcaagacagttatggataacataaaggaaggtggggatgacgtcaaatcatcatgccccttatgcttagggctacacacgtgctacaatggctgtaacaaagagaagcaaagtcgcaaggcggagcaaacctgaaaaaagcagtccaagttcggattgtgggctgaaactcgcccacatgaagtcggagttactagtaatcgcgaatgagaatgtcgcggtgaatgcgttcccgggtcttgtacacaccgcccgtcacaccatgggagctgagggtacccaaagtcagtgatctaacgtaagaagaagctgcctaaggtaaagttagtgactggggggaagtcgt

SEQ ID NO: 872 - DNA, 1356 bp, Eubacterium tenue
  modified_base (1343)..(1343): a, c, t, g, unknown or other
  modified_base (1349)..(1349): a, c, t, g, unknown or other
tcgagcgattctcttcggagaagagcggcggacgggtgagtaacgcgtgggtaacctgccctgtacacacggataacataccgaaaggtatgctaatacgagatgatatataattgttgcatgatttttatatcaaagcttttgcggtacaggatggacccgcgtctgattatctagttggtaaggtaacggcttaccagggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtagacttgagtgcaggagaggagagtggaattcctagtgtagcggtgaaatgcgtagatattaggaggaacaccagtagcgaagcggctctctggactgtactgacgctgaggcacgaaagcgtggggagcaaacaggattagataccctggtagtccacgccgtaaacgatgagtactagtgtcgggggttacccccctcggtgccgcagctaacgcattaagtactccgcctgggaagtacgctcgcaagagtgaaactcacaggaattgacggggacccgcacaagtagcggatcatgtggtttaattcgaagcaacgcgaacaaccttacctaaacttgacatccccttgacctctcccgtatcggatatttcccgtcggggacagtggtgacaggtggtgcatgattgccgtcagctcgtgtcgtgagatgatgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctancctttnggaagcg

SEQ ID NO: 873 - DNA, 1486 bp, Eubacterium tortuosum
  modified_base (1)..(1): a, c, t, g, unknown or other
  modified_base (123)..(123): a, c, t, g, unknown or other
  modified_base (347)..(347): a, c, t, g, unknown or other
  modified_base (970)..(970): a, c, t, g, unknown or other
  modified_base (1026)..(1026): a, c, t, g, unknown or other
  modified_base (1051)..(1051): a, c, t, g, unknown or other
ncaaatggagagtttgatcctggctcaggatgaacgctggcggcatgcctaatacatgcaagtcgaacgaagtcaattgaaagcttgcttttaaaagacttagtggcgaacgggtgagtaacncgtaggtaacctacccatgtaactgggataactgctggaaacggtagctaaaaccggataggtaagattgaggcatcttaatcttatgaaaaaagctttcgggctttgaacatggatggacctgcggcgcattagctagttggtgaggtaacggctcaccaaggcgatgatgcgtagccgacctgagagggtgaacggccacattgggactgagacacggcccnaactcctacgggaggcagcagtagggaattttcgtcaatggggggaaccctgaacgagcaatgccgcgtgagtgaagaaggtcttcggatcgtaaagctctgttgtaagtgaagaaagatgtatataggaaatgatatacaagtgacggtagcttaccagaaagccacggctaactacgtgccagcagccgcggtaatacgtaggtggcaagcgttatccggaatcattgggcgtaaagggtgcgtaggtggtacattaagtctgaagtaaaaggcatcagctcaactgatgttagctttggaaactgatgaactagagtgcagaagagggcaatggaattccatgtgtagcggtaaaatgcgtagatatatggaggaacaccagtggcgaaggcggttgcctggtctgtaactgacactgatgcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgaagnaacgcgaagaaccttaccaggccttgacatggatgtaaaagccctagagatagggnaataggtatacatcacacaggtggngcatggttgtcgtcagctcgtgtcgtgagatgttgggttaagtcccgcaacgagcgcaacccttgtcacatgttaccaatattaagttagggactcatgtgagactgccggtgacaaaccggaggaaggtggggatgacgtcaaatcatcatgccccttatggcctgggctacacacgtactacaatggcgactacaaagagcagcgaacctgcgaaggcaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggg

SEQ ID NO: 874 - DNA, 1378 bp, Eubacterium ventriosum
caccttggacagaatccttcgggaggaagaccattgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctagttggtgaggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaagaagaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactacgtgtcgggggacaatagttcctcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccactgacaggtcagtaatgtgaccctttcctcggaacagtggagacaggtggtgcatggttgtcgtcagctcgtgtcgtgagatgttgggttaagtcccgcaacgagcgcaacccttgtctttagtagccagcagtccggctgggcactctagagagactgccagggataacctggaggaaggcggggatgacgtcaaatcatcatgccccttacgagcagggctacacacgtgctacaatggcgtaaacaaagggaagcgaccccgtgagggcaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggatatgcccgaagtcagtgacccaaccgtaaggagg

SEQ ID NO: 875 - DNA, 1496 bp, Eubacterium xylanophilum
  modified_base (1)..(2): a, c, t, g, unknown or other
  modified_base (267)..(267): a, c, t, g, unknown or other
  modified_base (366)..(366): a, c, t, g, unknown or other
  modified_base (551)..(552): a, c, t, g, unknown or other
  modified_base (618)..(618): a, c, t, g, unknown or other
  modified_base (634)..(635): a, c, t, g, unknown or other
  modified_base (854)..(854): a, c, t, g, unknown or other
  modified_base (972)..(973): a, c, t, g, unknown or other
  modified_base (1201)..(1202): a, c, t, g, unknown or other
  modified_base (1391)..(1392): a, c, t, g, unknown or other
  modified_base (1409)..(1409): a, c, t, g, unknown or other
  modified_base (1448)..(1448): a, c, t, g, unknown or other
  modified_base (1456)..(1456): a, c, t, g, unknown or other
nnaatttgagagtttgatcctggctcaggatgaacgctggcggcgtgcttaacacatgcaagtcgaacgaagcatctctcccgaagattgaagtagcttgctacagattgattcatttgagatgacttagtggcggacgggtgagtaacgcgtgggtaacctgcctcatagagggggacaacagttggaaacgactgctaataccgcataacatgtgactgtcacatgacagacacatcaaagcttttgcgctatgagatggacccncgtctgattagctagttggtaaggtaacggcttaccaaggcgacgatcagtagccggcttgagagagtgaacggccacattgggactgagacacggccnagactcctacgggaggcagcagtggggaatattgcacaatgggggaaaccctgatgcagcgacgccgcgtgagtgaagaagtatttcggtatgtaaagctctatcagcagggaagataatgacggtacctgactaagaagccccggctaactacgtgccagcagccgcggtaatacgtagggggnnagcgttatccggatttactgggtgtaaagggagcgtaggtggcaaggcaagtcagatgtgaaatgncggggctcaaccccgnnactgcatttgaaactgtctagctagagtgcaggagaggtaagtggaattcctagtgtagcggtgaaatgcatagatattaggaggaacaccagtggcgaaggcggcttactggactgtaactgacactgaggctcgaaagcgtggggagcaaacaggattagataccctggtagtccacgccgtaaacgatgaatactaggtgtcggggcccacagggnttcggtgccgcagcaaacgcattaagtattccacctggggagtacgttcgcaagaatgaaactcaaaggaattgacggggacccgcacaagcggtggagcatgtggattaattcgaannaacgcgaagaaccttaccaagtcttgacatcctgctgaccgttccttagtcggaacttctcttcggagcagcagagacaggtggtgcatggttgtcgtcagctcgtgtcgtgagatgttgggttaagtcccgcaacgagcgcaacccttattcttagtagccagcattttggatgggcactctagggagactgccggagacaatccggaggaaggtggggatgacgtnnaatcatcatgccccttatgacttgggcttcacacgtgctacaatggtgactacaaagtgaagcgaccctgtgaaggtaagccaaccacaaaaaggtcatctcagttcggattgtagtctgcaactcgactacatgaagctggaatcgctagtaatcgcaaatcagcatgttgcggtgaatacgttcccnngtcttgtacacaccgcncgtcacaccatgggagttggatatgcccgaagccggtgncccaaccntaaggagggagccgtcgaaggtggagccaatgactggggt

SEQ ID NO: 876 - DNA, 1536 bp, Eubacterium yurii
ttttaattgagagtttgatcctggctcaggatgaacgctggcggcgtgcctaacacatgcaagtcgaacgaagtatatatatgaagtcttcggatggaatataaataacttagtggcggacgggtgagtaacgcgtaagtaatcaacctgtgacacacggataactgatagaaatgtcagctaatacgagatgaactgtttagattgggaaatggaaacagcaaagcgaaagcggtcacagacgagcttgcgtctgattagctagttggtggggtaagagcctaccaaggcgacgatcagtagccggcctgagagggtgaacggccacattggaactgagacacggtccaaactcctacgggaggcagcagtgggggatattgcacaatggggggaaccctgatgcagcaacgccgcgtgagtgaagaaggccctagggtcgtaaagctctgtcgtatgggaagaaacaaatgactgtaccatacaagaaagccccggctaactacgtgccagcagccgcggtaatacgtagggggcaagcgttatccggaattactgggcgtaaagggtgcgtaggcggctagttaagtcgaggttaaaaggcagtagctcaactactgttgggccttgaaactaattagcttgagtataggagaggaaagtggaattcccggtgtagcggtgaaatgcgtagatatcgggaggaataccggtggcgaaggcgactttctggactataactgacgctgaggcacgaaagcgtgggtagcaaacaggattagataccctggtagtccacgccgtaaacgatgaacactaggtgtcgggaggaatttcggtgccggcgcaaacgcaataagtgttccgcctggggagtacgttcgcaagaataaaactcaaaggaattgacggggacccgcacaagtagcggagcatgtggtttaattcgaagcaacgcgaagaaccttacctaagcttgacatggggatgaaaagcaatgtaaagttgtaatgatactttcgggtatacatcccacacaggtggtgcatggttgtcgtcagctcgtgtcgtgagatgttgggttaagtcccgcaacgagcgcaacccctattgatagttgccagtgcgttatggtaggcactctatcaagacagttatggataacataaaggaaggtggggatgacgtcaaatcatcatgccccttatgcttagggctacacacgtgctacaatggctgtaacaaagagaagcaaggtcgcaaggcggagcaaacctgaaaaaagcagtccaagttcggattgtgggctgaaactcgcccacatgaagtcggagttactagtaatcgcgaatcagaatgtcgcggtgaatgcgttcccgggtcttgtacacaccgcccgtcacaccatgggagctgagggtacccaaagtcagtgatctaacgaaagaagaagctgcctaaggtaaacttagtgactggggtgaagtcgtaacaaggtagccgtatcggaaggtgcggctggatcacctcctttct

SEQ ID NO: 877 - DNA, 1534 bp, Ewingella americana
agagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgggcttgacccgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcct

SEQ ID NO: 878 - DNA, 1412 bp, Exiguobacterium acetylicum
  modified_base (1360)..(1362): a, c, t, g, unknown or other
  modified_base (1364)..(1365): a, c, t, g, unknown or other
gcgcaggaagctgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagagggaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccnnnannccacgagagtttgcaacacccgaagccggtgaggtaaccgcaaggag

SEQ ID NO: 879 - DNA, 1505 bp, Facklamia hominis
  modified_base (344)..(344): a, c, t, g, unknown or other
  modified_base (364)..(365): a, c, t, g, unknown or other
  modified_base (638)..(638): a, c, t, g, unknown or other
  modified_base (652)..(652): a, c, t, g, unknown or other
cgaacgctggcggcgtgcctaatacatgcaagtcgaacgaacggagctaggaactgaacccggcaaagttagtggcgcacgggtgagtaacacgtggagaacctacccttttgcgggggataaccattggaaacgatgactaataccgcatagaatcgcagatcgcatgatcaacgaaggaaagacggcttcggctgtcgcaaaaggatggctccgcggtgcattagctagatggtggggtaacggcctaccatggcaatgatgcatagccgacctgagagggtgatcggccacattgggactgagacacggcccaaactcctacgggaggcagcagtagggantcttccgcaatgggcgcaannctgacggagcaacgccgcgtgtgtgaagaaggtcttcggatcgtaaagcactgttgttagagaagaacgaccgctagagtaactgttagcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtncagaagaggaaagnggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaagcccttcggggcaagaagacaggtggtgcatggttgtcgtcagctcgtgtcgtgagatgttgggttaagtcccgcaacgagcgcaacccttatcactagttgccagcattcagatggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaactttatgaagccgtcgaaggtgggacagatgattggggtgaagtcgtaacaaggtagccgtatcggaaggtgcggctgg

SEQ ID NO: 880 - DNA, 1367 bp, Faecalibacterium prausnitzii
tcgaacgagcgagagagagcttgctttctcagagcgagtggcgaacgggtgagtaacgcgtgaggaacctgcctcaaagagggggacaacagttggaaacgactgctaataccgcataagcccacaggtcggcatcgagcagagggaaaaggagcaatccgctttgagatggcctcgcgtccgattagctagttggtgaggtaacggcccaccaaggcaacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatctatgggctcaacccataaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgatgctggaaacagtattttccttcgggacgcagagacaggtggtgcatggttgtcgtcagctcgtgtcgtgagatgttgggttaagtcccgcaacgagcgcaacccttactgtcagttactacgcaagaggactctggcaggactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgtggatcagcatgccacggtgaatacgttcccgggccttgtacacaccgcccgtcacaccatgagagccggggggacccgaagtcggtagtctaaccgcaaggagg

SEQ ID NO: 881 - DNA, 1530 bp, Filifactor alocis
agagtttgatcctggctcaggatgaacgctggcggcgtgcttaacacatgcaagtcgaacgaacgactattaacagaacctttcggggcgaagaatatagaagttagtggcggacgggtgcgtaacgcgtgggtaatctgcctttgtcaaaggaataactattcgaaagaatagctaaaaccgtataacatattaatagggcatcctaataatatcaaaactgaggtggacaaagatgagcccgcgtctgattagctagttggtgagataaaagcccaccaaggcaacgatcagtagccgacctgagagggtgaacggccacattggaactgagacacggtccaaactcctacgggaggcagcagtggggaatattgcacaatggggggaaccctgatgcagcaacgccgcgtgagtgaagaaggcattcgtgtcgtaaaactctgtagtaggggaagaaagaaatgacagtaccctaaaagaaagccccggctaactacgtgccagcagccgcggtaatacgtagggggcaagcgttatccggaataactgggcgtaaagggtgcgcaggtggtttaacaagttagtggtgaaaggcataggctcaaccaatgtaagccattaaaactgtttaacttgagtgcaggagaggaaagtggaattcctagtgtagcggcgaaatgcgtagatattaggaggaataccagtggcgaaggcgactttctggactgcaactgactctgaggcacgaaagcgtggggagcaaacaggattagataccctggtagtccacgccgtaaacgatgagtactaggtgtcgagtgaagaactcggtgccgaagttaacacattaagtactccgcctggggagtacgctcgcaagagtaaaactcaaaggaattgacggggacccgcacaagcagcggagcatgtggtttaattcgaagcaacgcgaagaaccttacctaaacttgacataccaatgacagccttttaatcgaggacttttaccttcgggtagacaatggatacaggtggtgcatggttgtcgtcagctcgtgtcgtgagatgttgggttaagtcccgcaacgagcgcaacccttgtcgatagttaccagcagtaagatggggactctatcgagacagctaaggacaacttagaggaaggtggggatgacgtcaaatcatcatgccccttatgtttagggctacacacgtgctacaatggtcattacagagagaagcgaaactgcgaagtcaagcaaacctcaaaaagatgatccaagttcggattgtaggctgaaactcgcctacatgaagttggagttgctagtaatcgcgaatcagaatgtcgcggtgaatgcgttcccgggtcttgtacacaccgcccgtcacaccatgggagtttggggggcccaaagtcagcgactcaaccgcaaggagagagctgcccaaggcaaaacaaatgactggggtgaagtcgtaacaaggtagccgtatcggaaggtgcggctggatcacctcctttct

SEQ ID NO: 882 - DNA, 1450 bp, Filifactor villosus
gatgaacgctggcggcgtgcttaacacatgcaagtcgaacgggcgaattatatcggaggtcttcgggccaaagagataataagctagtggcggacgggtgcgtaacgtgtgggtaatctgcctttgtcataggaataactgcttgaaaaagtagctaataccaaataacatatcgtataggcatctataagatatcaaagagaaatcggacaaagatgagcccgcatctgattagctggttggtagggtaaaagcctaccaaggcgacgatcagtagccggcctgagagggtgaacggccacattggaactgagacacggtccaaactcctacgggaggcagcagtggggaatattgcacaatggggggaaccctgatgcagcaacgccgcgtgagtgaagaaggctttcgagtcgtaaaactctgttgtaagggaagataatgacggtaccttaaaagaaagccccggctaactacgtgccagcagccgcggtaatacgtagggggcaagcgttatccggaataactgggcgtaaagggtgcgcaggtggtctgtcaagttagtggtgaaaggcataggctcaaccaatgtaagccattaaaactgacggacttgagtgcaggagaggaaagtggaattcctagtgtagcggtgaaatgcgtagatattaggaggaataccggtggcgaaggcgactttctggactgtaactgacactgaggcacgaaagcgtggggagcaaacaggattagataccctggtagtccacgccgtaaacgatgagtactaggtgtcgggaggaatctcggtgccgaagttaacacattaagtactccgcctggggagtacgctcgcaagagtaaaactcaaaggaattgacggggacccgcacaagcagcggagcatgtggtttaattcgaagcaacgcgaagaaccttacctaaacttgacataccgatgccgattcggtaatgcgaattttcctttcggggacattggatacaggtggtgcatggttgtcgtcagctcgtgtcgtgagatgttgggttaagtcccgcaacgagcgcaacccttgtcaatagttgccagcatataaggtggggactctattgagacagctaaggacaacttagaggaaggtggggatgacgtcaaatcatcatgccccttatgtttagggctacacacgtgctacaatggtcattacagagggaagcgagattgtgaaatggagcaaaccccaaaaagatgatctaagttcggattgtaggctgaaactcgcctacatgaagttggagttgctagtaatcgcaaatcaaaatgttgcggtgaatgcgttcccgggtcttgtacacaccgcccgtcacaccatgggagttcggggggcccaaagtcagtgagcaaaccgcgagggtgcagctgcctaaggcaaaacgaatgactggggtg

SEQ ID NO: 883 - DNA, 1525 bp, Finegoldia magna
ttaaattgagagtttgatcctggctcaggacgaacgctggcggcgtgcttaacacatgcaagtcgaacgggatttagtaaacagaagcttcggtggaagattactaatgagagtggcgaacgggtgagtaacgcgtgagcaacctgcctatgacagtgggatagcctcgggaaaccgggattaataccgcataaaatcgtagaaacacatgttttaacggtcaaagatttatcggtcatagatgggctcgcgtctgattagctagttggtgagataacagcccaccaaggcgacgatcagtagccggtctgagaggatgaacggccacattggaactgagacacggtccaaactcctacgggaggcagcagtggggaatattgcacaatgggggaaaccctgatgcagcgacgccgcgtgaacgaagaaggtattcgtatcgtaaagttctgtcctatgggaagataatgacagtaccatagaagaaagctccggctaaatacgtgccagcagccgcggtaatacgtatggagcgagcgttgtccggaattattgggcgtaaagggtacgcaggcggtttaataagtcgaatgttaaagatcggggctcaaccccgtaaagcattggaaactgataaacttgagtagtggagaggaaagtggaattcctagtgtagtggtgaaatacgtagatattaggaggaataccagtagcgaaggcgactttctggacacaaactgacgctgaggtacgaaagcgtggggagcaaacaggattagataccctggtagtccacgccgtaaacgatgaatgctaggtgttgggggtcaaacctcggtgccgaagttaacacattaagcattccgcctggggagtacgcacgcaagtgtgaaactcaaaggaattgacggggacccgcacaagcagcggagcatgtggtttaattcgatgcaacgcgaagaaccttaccagggcttgacatgtgggtgaaaggtatagagatatacccctctctttatgagacatccatacaggtggtgcatggttgtcgtcagctcgtgtcgtgagatgttgggttaagtcccgcaacgagcgcaacccctatacttagttaccagcgagtaatgtcggggactctaagtagactgccgatgacaaatcggaggaaggtggggatgacgtcaaatcatcatgccctttatgtcctgggctacacacgtgctacaatggttggtacagagggaagctatatagtgatataatgcaaaactccaaagccaatcccagttcggattgtaggctgcaactcgcctacatgaagtcggagttgctagtaatcgcggatcagaatgtcgcggtgaatgcgttcccgggtcttgtacacaccgcccgtcacaccatgggagttgataatacccgaagcctgtgacctaattgaggagcagtcgaaggtaggattgatgactggggtgaagtcgtaacaaggtagccgtatcggaaggtgcggctggatcacctcctttct

SEQ ID NO: 884 - DNA, 1291 bp, Flavobacteriaceae genomosp. C1
gatgaacgctagcgggaggcctaacacatgcaagctgagcgagcggcgtacgggtgcggaacacgtgtgcgacctgcctttatctgggggatagcctttcgaaaggaagattaatactccataatgaaaggcggatagagatgggcacgcgcaagattagctagttggtgaggtaacggctcaccaaggcaatgatctttagggggcctgagagggtgatcccccacactggtactgagacacggaccagactcctacgggaggcagcagtgaggaatattggtcaatgggtgcaagcctgaaccagccatcccgcgtgaaggacgactgcctatgggttgtaaacttcttttgtatagggatatgaaggtactatacgaataagcaccggctaactccgtgccagcagccgcggtaatacggagggtgcaagcgttatccggatttattgggtttaaagggtccgtaggcggacttataagtcagtggtgaaatcctgtcgcttaacgatagaactgccattgatactgtaagtcttgagtatatttgaggtagctggaataagtagtgtagcggtgaaatgcatagatattacttagaacaccaattgcgaaggcaggttaccaagataactgacgctgagggacgaaagcgtggggagcgaacaggattagataccctggtagtccacgccgtaaacgatgctaactcgtttttggagcttcagagaccaagcgaaagtgataagttagccacctggggagtacgctcgcaagagtgaaactcaaaggagttgacgggggcccgcacaagcggtggattatgtggtttaattcgatgatacgcgaggaaccttaccaagacttaaatggtcaaggtgctgcatggttgtcgtcagctcgtgccgtgaggtgttaggttaagtcctgcaacgagcgcaacccctgtcactagttgccatcatggggactctagtgagactgcctacgcaagtaggaggaaggtggggatgacgtcaaatcatcacggcccttacgtcttgggccacacacgtaatacaatggccggcagagggcagctacacagcgatgtgatgcaaatctcgccggtctcagttcggatggagtctgcaactcgactctagaagctggaatcgctagtaatcgcgcatcagccatggcgcggtgaatacgttcccgggccttgtacacaccgcccgtcaagccatggaagctgggggtacctgaagtcggtaccaggagctgcctagggtaaaactagtaactagggc

SEQ ID NO: 885 - DNA, 1480 bp, Flavobacterium sp. NF2-1
agagtttgatcctggctcaggatgaacgctagcggcaggcttaacacatgcaagtcgaggggtaggagaagcttgcttttctgagaccggcgcacgggtgcgtaacgcgtatgcaatctacctttcacagagggatagcccagagaaatttggattaataccttatagtattatagaatggcatcattttataattaaagatttatcggtgaaagatgagcatgcgtcccattagctagttggtatggtaacggcataccaaggcaacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttatacaggaagaaacccctctacgtgtagagacttgacggtactgtaagaataaggatcggctaactccgtgccagcagccgcggtaatacggaggatccaagcgttatccggaatcattgggtttaaagggtccgtaggcggtcagataagtcagtggtgaaagcccatcgctcaacggtggaacggccattgatactgtctgacttgaattattaggaagtaactagaatatgtagtgtagcggtgaaatgcttagagattacatggaataccaattgcgaaggcaggttactactaatatattgacgctgatggacgaaagcgtgggtagcgaacaggattagataccctggtagtccacgccgtaaacgatggatactagctgttgggcgcaagttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgtagattgaccggtttggaaacagatctttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggtgaccaggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgta

SEQ ID NO: 886 - DNA, 1465 bp, Flavonifractor plautii
cgctggcggcgtgcttaacacatgcaagtcgaacggggtgctcatgacggaggattcgtccaatggattgagttacctagtggcggacgggtgagtaacgcgtgaggaacctgccttggagaggggaataacactccgaaaggagtgctaataccgcatgaagcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaggcagagatgcgttaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtag

SEQ ID NO: 887 - DNA, 1467 bp, Flexispira rappini
  modified_base (1062)..(1062): a, c, t, g, unknown or other
  modified_base (1075)..(1075): a, c, t, g, unknown or other
agagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcgccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaactcttacctaggcttgacattgatagaatccgctagagatagtggagtgctggcttgccagagcttgaaaacaggtgctgcacggctgtcgtcagctcgtgtcgtgagatgttgggttaagtcccgcaacngagcgcaaccctnggtcccttagttgctagcagttcggctgagcactctaaggagactgccttcgtaaggaggaggaaggtgaggacgacgtcaagtcatcatggcccttacgcctagggctacacacgtgctacaatgggacatacaaaaagatgcaataccgcgaggtggagcaaatctctaaaatgtctctcagttcggattgtagtctgcaactcgactacataaagctggaatcgctagtaatcgtgaatcagcaatgtcacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgta

SEQ ID NO: 888 - DNA, 1541 bp, Flexistipes sinusarabici
agagtttgatcctggctcagaacgaacgctggcggcgtgcttaacacatgcaagtcagggggaatcctcccttcggggaggtagtacaccggcgcacgggtgagtaacgcgtgagtgacctacccattagacctggataacccggcgaaagttgggctaagacaggatgtgttaatacacttcatggtgtattgataaaggcaggtttcggcttgtgctaatggatgggctcgcgtctgattagctagttggtaaggtaaaggcttaccaaggcgacgatcattaggcggcctgagagggtggtcgcccacactggaactgagacacggtccagactcctacgggaggcagcagtggggaattttgcgcaatgggcgagagcctgacgcagcgacgccgcgtggacgaggaaggccttcgggtcgtaaagtccttttttacgggaagaaagttattaacagtaactggttaatatttgacggtaccgtaagaataagccccggctaactccgtgccagcagccgcggtaatacggagggggcgagcgttgttcggaattactgggcgtaaagcgtacgtaggcggcgtggtaagtcggaggttaaaggctacggctcaaccgtagtagggcctttgatactatcatgctagagtgtcggagggggtagcggaattccctgtgtagcggtgaaatgcgtagatatagggaagaacaccagtagcgaaggcggctacctggccgatcactgacgctgaggtacgagagcgtgggtagcaaacaggattagataccctggtagtccacgctgtaaacgatggacgctaggtgttggaggaaccgaccccttcagtgccgaagccaacgcgttaagcgtcccgcctggggagtacgaccgcaaggttaaaactcaaaggaattgacgggggcccgcacaagcggtggagcacgtggtttaattcgatgctaaccgaagaaccttacctggtcttgacatcctccggagggactagagatagttctgtgcccgcctttggcgggagcggagagacaggtgctgcatggctgtcgtcagctcgtgccgtgaggtgttgggttaagtcccgcaacgagcgcaacccctattcatagttgccatcggtaaggccgggcactctatggatactgcccgtgataaacgggaggaaggtggggacgacgtcaagtcatcatggcctttatgaccagggctacacacgtgctacaatggtacgtacagagggcagcgaagccgcgaggtgtagcgaatccctaaaagcgtgccttagttcggattgtagtctgcaattcgactacatgaaggcggaatcgctagtaatcgcaggtcagcaaaactgcggtgaatacgttcccgggccttgtacacaccgcccgtcacaccacgggagttggttgtacctgaagccggtggcccaactgcggagggagccgtttatggtatgactggcaactggggtgaagtcgtaacaaggtagccgtaccggaaggtgtggctggatcacct

SEQ ID NO: 889 - DNA, 1530 bp, Francisella novicida
ttaaactgaagagtttgatcctggctcagattgaacgctggtggcatgcttaacacatgcaagtcgaacggtaacaggtcttcggatgctgacgagtggcggacgggtgagtaacgcgtaggaatctgcccatttgagggggataccagttggaaacgactgttaataccgcataatatctgtggattaaaggtggctttcgggctgtcgcagatggatgagcctgcgttggattagctagttggtggggtaagggcccaccaaggctacgatccatagctgatttgagaggatgatcagccacattgggactgagacacggcccaaactcctacgggaggcagcagtggggaatattggacaatgggggcaaccctgatccagcaatgccatgtgtgtgaagaaggccctagggttgtaaagcactttagttggggaggaaagcctcaaggttaatagccttgggggaggacgttacccaaagaataagcaccggctaactccgtgccagcagccgcggtaatacggggggtgcaagcgttaatcggaattactgggcgtaaagggtctgtaggtggtttgttaagtcagatgtgaaagcccagggctcaaccttggaactgcatttgatactggcaaactagagtacggtagaggaatggggaatttctggtgtagcggtgaaatgcgtagagatcagaaggaacaccaatggcgaaggcaacattctggaccgatactgacactgagggacgaaagcgtggggatcaaacaggattagataccctggtagtccacgctgtaaacgatgagtactagctgttggagtcggtgtaaaggctctagtggcgcagctaacgcgataagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattgagactgccgctgacaaggcggaggaaggtggggacgacgtcaagtcatcatggcccttacgaccagggctacacacgtgctacaatgggtattacagagggctgcgaaggtgcgagctggagcgaaactcaaaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctta

SEQ ID NO: 890 - DNA, 1518 bp, Francisella philomiragia
agagtttgatcatggctcagattgaacgctggtggcatgcttaacacatgcaagtcgaacggtaacaggtcttcggatgctgacgagtggcggacgggtgagtaacgcgtaggaatctgcccatttgagggggataccagttggaaacgactgttaataccgcataatatctgtggattaaaggtggcttaggctgccgcagatggatgagcctgcgttggattagctagttggtggggtaagggcctaccaaggctacgatccatagctgatttgagaggatgatcagccacattgggactgagacacggcccaaactcctacgggaggcagcagtggggaatattggacaatgggggaaaccctgatccagcaatgccatgtgtgtgaagaaggctctagggttgtaaagcactttagttggggaggaaagcctataagttaatagcttgtaggaaggacgttacccaaagaataaggaccggctaactccgtgccagcagccgcggtaatacggggggtccgagcgttaatcggaattactgggcgtaaagggtctgtaggtggtttgttaagtcagatgtgaaagcccagggctcaaccttggaactgcatttgatactggcaaactagagtatggtagaggaatggggaatttctggtgtagcggtgaaatgcgtagagatcagaaggaacaccaatggcgaaggcaacattctggaccaatactgacactgagggacgaaagcgtggggatcaaacaggattagataccctggtagtccacgctgtaaacgatgagtactagctgttggattcggtgtaaaggatctagtggcgcagctaacgcgttaagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattgagactgccgctgacaaggcggaggaaggtggggacgacgtcaagtcatcatggcccttacgaccagggctacacacgtgctacaatgggtattacagagggctgcgaaggtgcgagctggagcgaaactcagaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctt

SEQ ID NO: 891 - DNA, 1530 bp, Francisella tularensis
ttaaactgaagagtttgatcctggctcagattgaacgctggtggcatgcttaacacatgcaagtcgaacggtaacaggtcttaggatgctgacgagtggcggacgggtgagtaacgcgtaggaatctgcccatttgagggggataccagttggaaacgactgttaataccgcataatatctgtggattaaaggtggctttcgggctgtcgcagatggatgagcctgcgttggattagctagttggtggggtaagggcccaccaaggctacgatccatagctgatttgagaggatgatcagccacattgggactgagacacggcccaaactcctacgggaggcagcagtggggaatattggacaatgggggcaaccctgatccagcaatgccatgtgtgtgaagaaggccctagggttgtaaagcactttagttggggaggaaagcctcaaggttaatagccttgggggaggacgttacccaaagaataagcaccggctaactccgtgccagcagccgcggtaatacggggggtgcaagcgttaatcggaattactgggcgtaaagggtctgtaggtggtttgttaagtcagatgtgaaagcccagggctcaaccttggaactgcatttgatactggcaaactagagtacggtagaggaatggggaatttctggtgtagcggtgaaatgcgtagagatcagaaggaacaccaatggcgaaggcaacattctggaccgatactgacactgagggacgaaagcgtggggatcaaacaggattagataccctggtagtccacgctgtaaacgatgagtactagctgttggagtcggtgtaaaggctctagtggcgcagctaacgcgataagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattaagactgccgctgacaaggcggaggaaggtggggacgacgtcaagtcatcatggcccttacgaccagggctacacacgtgctacaatgggtattacagagggctgcgaaggtgcgagctggagcgaaactcaaaaaggtactcttagtccggattgcagtctgcaactcgactgcatgaagtcggaatcgctagtaatcgcaggtcagaatactgcggtgaatacgttcccgggtcttgtacacaccgcccgtcacaccatgggagtgggttgctccagaagtagatagcttaacgaatgggcgtttaccacggagtgattcatgactggggtgaagtcgtaacaaggtagccgtaggggaacctgcggctggatcacctcctta

SEQ ID NO: 892 - DNA, 1445 bp, Fulvimonas sp. NML 060897
gcctaacacatgcaagtcgaacggcagcacagtggagcttgctccatgggtggcgagtggcggacgggtgagtaaggcatcgggatctacccagacgtgggggataacgtagggaaacttacgctaataccgcatacgtcctacgggagaaagcgggggaccttcgggcctcgcgcggctggacgaaccgatgtgcgattagctagttggtggggtaaaggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccttcgggttgtaaagcacttttatcaggagcgaaatactgccggctaatacccggcggggctgacggtacctgaggaataagcaccggctaacttcgtgccagcagccgcggtaatacgaagggtgcaagcgttaatcggaattactgggcgtaaagcgtgcgtaggcggttctttaagtctgctgtgaaatccccgggctcaacctgggaatggcagtggatactggggagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcggagtctgcaactcgactccgtgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtggttcatgactgg

SEQ ID NO: 893 - DNA, 1308 bp, Fusobacterium canifelinum
tggctcaggatgaacgctgacagaatgcttaacacatgcaagtctactgtggcggacgggtgagtaacgcgtaaagaacttgcctcacagctagggacaacatttggaaacgaatgctaatacctaatattgaaaggcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacgctgggctacacacgtgctacaatgggtagcagagagctgcaaagccgtgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtgaagtcgta

SEQ ID NO: 894 - DNA, 1294 bp, Fusobacterium genomosp. C1
gatgaacgctgacagaatgcttaacacatgcaagtcaacgagtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattccgtgtgcacgatgaagtttttcggaatgtaaagtgctttcagttgggaagatgacggtaccaacagaagaagtgacggctaaatacgtgccaacagccgcggtaatacgtatgtcacgagcgttatccggatttattgggcgtaaagcgcgcctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagactgacgctaaagcgcgagagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacgtggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcacgcgatactgcctacgatgagtaggaggaaggtggggatgacgtcaagtcattatgccccttatacgctgggctacacacgtgctacaatgggtagcagagagttgcaaagccgtgaggtgaagctaatctcagctatttttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcggcctagggatgctccgagggtgtgattagcgattggggtg

SEQ ID NO: 895 - DNA, 1294 bp, Fusobacterium genomosp. C2
gatgaacgctgacagaatgcttaacacatgcaagtcaactggtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattctgtgtgcacgatgaagtttttcggaatgcaaagtgctttcagttgggaagatgacggtaccaacagaagaagtgacggctaaatacgtgccagcagccgcggtaatatgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacactgggctacacacgtgctacaatgggtagcagagggttgcaaagccgtgaggtgaagctaatctcggctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtg

SEQ ID NO: 896 - DNA, 1509 bp, Fusobacterium gonidiaformans
gaacgaagagtttgatcctggctcaggatgaacgctgacagaatgcttaacacatgcaagtcgactcgagtcttcggacttgggtggcggacgggtgagtaacgcgtaaagaacttgcctcatagtctgggacaacatctggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttct

SEQ ID NO: 897 - DNA, 1671 bp, Fusobacterium mortiferum
aaaaaagtattgacgaaaaatattatttgtggtaatatataccttgtccgcgagagagcggaactgatgaataaggacattagcaacagaatagagaaagacaattaatgcaaacacaacaataaattggtgtaaaacaatcagtaaattttactgagttatatagattgaacgaagagtttgatcctggctcaggatgaacgctgacagaatgcttaacacatgcaagtctacttgatccttcgggtgatggtggcggacgggtgagtaacgcgtaaagaacttgccctgcagtctgggacaacatttggaaacgaatgctaataccggatattatgtgagtttcgcatgaaattcatatgaaagctatatgcgctgcaggagagctttgcgtcctattagctagttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggacgaagtaagtgacggtaccaacagaagaagcgacggctaaatacgtgccagcagccgcggtaatacgtatgtcgcaagcgttatccggatttattgggcgtaaagcgcgtctaggcggtttggtaagtctgatgtgaaaatgcggggctcaactccgtattgcgttggaaactgtcaaactagagtactggagaggtgggcggaactacaagtgtagaggtgaaattcgtagatatttgtaggaatgccgatggggaagccagcccactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaaattagcagagatgcttttgtgccccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgatgagcaggaggaaggtggggatgacgtcaagtcatcatgccccttatacgctgggctacacacgtgctacaatgggtagtacagagagtcgcaaacctgcgagggggagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacct

SEQ ID NO: 898 - DNA, 1473 bp, Fusobacterium naviforme
tagagtttgatcatggctcaggatgaacgctggcggcgtgcttaacacatgcaagtcgaacgagagctacaggaggaagttttcggatggaatccggtagatcgagtggcggacgggtgagtaacgcgtggggaacctgcctcatacagggggataacagttggaaacgactgttaataccgcataagaccacagagtcgcatgactcaggggtaaaaactccggtggtatgagatggacccgcgttcgattagccagttggcggggtaacggcccaccaaagcgacgatcgatagccgatttgagagaatgaccggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaagatgacggtacctgagtaagaagccccggctaactacgtgccagcagccgcggtaatacgtagggggcaagcgttatccggatttactgggtgtaaagggagcgcagacggctatgcaagtctgaagtgaaagcccggggctcaaccccgggactgctttggaaactgtgyagctagagtgtcggagaggtagcagaattcccagtgtagcggtgaaatgcgtagatattgggaagaataccggtggcgaaggcgcttactggacgataactgacgttcaggctcgaaggcgtggggagcaaacaggattagataccctggtagtccacgcggtaaacgatgaatactaggtgttggcatccaaaggatgtcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaagtcttgacatcccgatgaccggcctgtaaagaggccttctcttcggagcattggagacaggtggtgcatggttgtcgtcagctcgtgtcgtgagatgttgggttaagtcccgcaacgagcgcaacccctattgccagtagccagcaggtaaagctgggcactctggcgagactgcctgggataaccaggaggaaggtggggatgacgtcaaatcatcatgccccttatgatttgggcaacacacgtgctacaatggcgtaaacagagagaagcgaaggagcgatccggagcgaatctaaaaataacgtctcagttcggactgcagtctgcaactcgactgcacgaagctggaattgctagtaatcgcgaatcagcatgtcgcggtgaatacgttcccgggtcttgtacacaccgcccgtcacaccatgggagtcagcaacgcccgaagtcagtgacccaaccttagggagggagctgccgaaggcggggcggataactggggtgaa

SEQ ID NO: 899 - DNA, 1330 bp, Fusobacterium necrogenes
  modified_base (43)..(43): a, c, t, g, unknown or other
  modified_base (167)..(167): a, c, t, g, unknown or other
  modified_base (189)..(189): a, c, t, g, unknown or other
  modified_base (243)..(243): a, c, t, g, unknown or other
  modified_base (258)..(258): a, c, t, g, unknown or other
  modified_base (261)..(261): a, c, t, g, unknown or other
  modified_base (302)..(302): a, c, t, g, unknown or other
  modified_base (314)..(314): a, c, t, g, unknown or other
  modified_base (361)..(361): a, c, t, g, unknown or other
  modified_base (632)..(632): a, c, t, g, unknown or other
  modified_base (846)..(846): a, c, t, g, unknown or other
  modified_base (887)..(887): a, c, t, g, unknown or other
  modified_base (900)..(900): a, c, t, g, unknown or other
  modified_base (902)..(902): a, c, t, g, unknown or other
  modified_base (914)..(914): a, c, t, g, unknown or other
  modified_base (997)..(997): a, c, t, g, unknown or other
  modified_base (1074)..(1074): a, c, t, g, unknown or other
  modified_base (1091)..(1091): a, c, t, g, unknown or other
  modified_base (1139)..(1139): a, c, t, g, unknown or other
  modified_base (1172)..(1172): a, c, t, g, unknown or other
tggtggcggacgggtgagtaacgcgtaaagaacttgccctgcngtctgggacaacatttggaaacgaatgctaataccggatattatgtgagtttcgcatgaaattcatatgaaagctatatgcgctgtgggagagctttgcgtcctattagctagttggtgaggtnacggctcaccaaggcgatgatnggtagccggcctgagagggtgaacggccacaaggggactgagacacggcccttnctcctacgggaggcngcngtggggaatattggacaatggaccaaaagtctgatccagcnattctgtgtgcncgatgaagtttttcggaatgtaaagtgctttcagttgggacgaagtnagtgacggtaccaacagaagaagcgacggctaaatacgtgccagcagccgcggtaatacgtatgtcgcaagcgttatccggatttattgggcgtaaagcgcgtctaggcggtttggtaagtctgatgtgaaaatgcggggctcaactccgtattgcgttggaaactgccaaactagagtactggagaggtgggcggaactacaagtgtagaggtgaaattcgtagatatttgtaggaatgccgatggggaagccagcccactggacagatnctgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggaccgcacaagcggtggagcatgtggtttaattcgacgnaacgcgaggaaccttaccagcgtttgacatcctaagaaatnagcagagatgctntngtgcttcggggnaacttagtgacaggtggtgcatggctgtcgtcagctcgtgtcgtgagatgttgggttaagtcccgcaacgagcgcaacccctntcgtatgttgccatcattaagttgggcactcatgcgatactgcctgcgatgagcaggaggaaggtggggatgacgtnaagtcatcatgcccctnatacgctgggctacacacgtgctacaatgggtagtacagagagtcgcnaacctgcgagggggagctaatctcagaaaactnttctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccg

SEQ ID NO: 900 - DNA, 1487 bp, Fusobacterium necrophorum
tttgatcctggctcaggatgaacgctgacagaatgcttaacacatgcaagtcgactcgagtcttcggacttgggtggcgcacgggtgagtaacgcgtaaagaacttgcctcttagaccgggacaacatctggaaacggatgctaataccggatattatggttttttcgcatggaggaatcatgaaagctagatgcgctaagagagagctttgcgtcccattagctagttggtgaggtaacggcccaccaaggcaatgatgggtagccggcctgagagggtgaacggccacaaggggactgagacacggcccttactcctacgggaggcagcagtggggaatattggacaatggaccacaagtctgatccagcaattctgtgtgcacgatgacgtttttcggaatgtaaagtgctttcagtcgggaagaagtcagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggagctcaactccgtatggcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggaccgcacaagcggtggagcatgtggtttaattcgacgcaacgcgaggaaccttaccagcgtttgacatcctacgaacggagcagagatgcgccggtgccctttcgggggaacgtagtgacaggtggtgcatggctgtcgtcagctcgtgtcgtgagatgttgggttaagtcccgcaacgagcgcaacccctatcgtatgttaccatccttcagttggggactcatgcgatactgcctgcgacgagcaggaggaaggtggggatgacgtcaagtcatcatgccccttatacgctgggctacacacgtgctacaatgggtagtacagagagcggcaaacccgcgagggggagcaaatctcagaaaactattcttagttcggatggtactctgcaactcgagtacatgaagttggaatcgctagtaatcgcaaatcagcaatgttgcggtgaatacgttctcgggtcttgtacacaccgcccgtcacaccacgagagtgggttgcaactgaagtagcaggcctaaccttagggaaggatgctccgagggtgtggttagcgattggggtgaagtcgtaacaaggtatccgtacgggaacgtgcggctggatc

SEQ ID NO: 901 - DNA, 1523 bp, Fusobacterium nucleatum
ttgaacgaagagtttgatcctggctcaggatgaacgctgacagaatgcttaacacatgcaagtctacttgaatttgggttttttaacttcgatttgggtggcggacgggtgagtaacgcgtaaagaacttgcctcacagctagggacaacatttggaaacgaatgctaatacctgatattatgattatagggcatcctagaattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgttccgagggtgtgattagcgattggggtgaagtcgtaacaaggtatccgtacgggaacgtgcggatggatcacctcctttct

SEQ ID NO: 902 - DNA, 1509 bp, Fusobacterium periodonticum
ttgaacgaagagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaagagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 903 - DNA, 1453 bp, Fusobacterium russii
  modified_base (1)..(2): a, c, t, g, unknown or other
  modified_base (298)..(298): a, c, t, g, unknown or other
  modified_base (321)..(322): a, c, t, g, unknown or other
  modified_base (511)..(511): a, c, t, g, unknown or other
  modified_base (885)..(885): a, c, t, g, unknown or other
  modified_base (893)..(893): a, c, t, g, unknown or other
  modified_base (895)..(895): a, c, t, g, unknown or other
  modified_base (901)..(901): a, c, t, g, unknown or other
  modified_base (926)..(928): a, c, t, g, unknown or other
  modified_base (1159)..(1160): a, c, t, g, unknown or other
  modified_base (1375)..(1375): a, c, t, g, unknown or other
  modified_base (1449)..(1450): a, c, t, g, unknown or other
nngaacgaagagtttgatcctggctcaggatgaacgctgacagaatgcttaacacatgcaagtcaacttgaacttcggtttgggtggcggacgggtgagtaacgcgtaaagaacttgcctcacagactgggacaacatttggaaacgaatgctaagaccggatattatgaattcattgcatgatgaagtcatgaaagctataagcgctgtgagagagctttgcgtcccattagctagttggagaggtaacggctcaccaaggcgatgatgggtagccggcctgagagggtgaacggcnacaaggggactgagacacggccnntactcctacgggaggcagcagtggggaatattggacaatggaccaagagtctgatccagcaattctgtgtgcacgatgaagtttttcggaatgtaaagtgctttcagttgggaagaagaaagtgacggtaccaacagaagaagcgacggctaaatacgtgccagcagccgcggtaatacgtatgctgcnagcgttatccggatttattgggcgtaaagcgcgtctaggcggctagataagtctgatgtgaaaatgcggggctcaactccgtattgcgttggaaactgtatagctagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattganggggaccngnacaagnggtggagcatgtggtttaattcgannnaacgcgaggaaccttaccagcgtttgacatcctactaagggctcagagatgagcttgtgctccttcgggagaaagtagagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtnnagtcatcatgccccttatacgctgggctacacacgtgctacaatgggtagaacagagagtggcgaagctgtgaagtggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacnccacgagagttggttgcacctgaagtaacaggcctaaccgaaaggagggatgttccgagggtgtgattagcgannggg

SEQ ID NO: 904 - DNA, 1522 bp, Fusobacterium sp. 11_3_2
ttgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 905 - DNA, 1496 bp, Fusobacterium sp. 12_1B
agagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgattgggtcgcatgatctggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacct

SEQ ID NO: 906 - DNA, 1509 bp, Fusobacterium sp. 1_1_41FAA
ttgaacgaagagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcacttcggtgaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacctcctttct

SEQ ID NO: 907 - DNA, 1494 bp, Fusobacterium sp. 2_1_31
agagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcacttcggtgaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacct

SEQ ID NO: 908 - DNA, 1522 bp, Fusobacterium sp. 3_1_27
ttgaacgaagagtttgatcctggctcaggatgaacgctgacagaatgcttaacacatgcaagtcaacttgaatttgggtttttaacttaggtttgggtggcggacgggtgagtaacgcgtaaagaacttgcctcacagctagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggagtgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 909 - DNA, 1522 bp, Fusobacterium sp. 3_1_33
ttgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 910 - DNA, 1513 bp, Fusobacterium sp. 3_1_36A2
agagtttgatcctggctcaggatgaacgctgacagaatgcttaacacatgcaagtcaacttgaatttgggtttttaacttaggtttgggtggcggacgggtgagtaacgcgtaaagaacttgcctcacagctagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttct

SEQ ID NO: 911 - DNA, 1369 bp, Fusobacterium sp. 3_1_5R
ggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttct

SEQ ID NO: 912 - DNA, 1301 bp, Fusobacterium sp. AC18
tcaggatgaacgctgacagaatgcttaacacatgcaagtcaactggtggcggacgggtgagtaacgcgtaaagaacttgcctcacagatagggacaacatttggaaacgaatgctaatacctgatattgaaaggcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctgcgatgagcaggaggaaggtggggatgacgtcaagtcatcatgccccttatacgctgggctacacacgtgctacaatgggtagcagagagtcgcaaagccgtgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgatggggtgaagtc

SEQ ID NO: 913 - DNA, 1300 bp, Fusobacterium sp. ACB2
tggctcaggatgaacgctgacagaatgcttaacacatgcaagtcaactggtggcggacgggtgagtaacgcgtaaagaacttgcctcacagctagggacaacatttagaaatgaatgctaatacctgatattgaaaggcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggacgagagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgctgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctacgatgagtaggaggaaggtggggatgacgtcaagtcatcatgccccttatacgctgggctacacacgtgctacaatgggtagcagagagttgcaaagccgtgaggtgaagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattgggg

SEQ ID NO: 914 - DNA, 1364 bp, Fusobacterium sp. AS2
ggctcaggatgaacgctgacagaatgcttaacacatgcaagtcaacttgaacttcggtttgggtggcggacgggtgagtaacgcgtaaagaacttgcctcacagatagggacaacatttggaaacgaatgctaatacctgatattatgattttagggcatcctaggattatgaaagctatatgcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatataagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagt

SEQ ID NO: 915 - DNA, 1387 bp, Fusobacterium sp. CM1
gaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctatatgcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagca

SEQ ID NO: 916 - DNA, 1385 bp, Fusobacterium sp. CM21
cgctgacagaatgcttaacacatgcaagtcaacttgaatttgggtttttaacttaggtttgggtggcggacgggtgagtaacgcgtaaagaacttgcctcacaggtagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaacaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaagggtgggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagc

SEQ ID NO: 917 - DNA, 1210 bp, Fusobacterium sp. CM22
  modified_base (975)..(975): a, c, t, g, unknown or other
  modified_base (1090)..(1090): a, c, t, g, unknown or other
gtggcggacgggtgagtaacgcgtaaagaacttgcctcacagatagggacaacatttggaaacgaatgctaatacctgatattgaaaggcactgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagtctgatccagcaattctgtgtgcacgatgaagtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagactgacgctgaagcgcgaaagcgtgggtagcaaacaggattagataccctggtagtccacgccgtaaacgatgattactaggtgttggggcctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaacccctttcgtatgttaccatcatggggactcatgcgatactgcctgcgatgagcaggaggaaggtggggatgacgtcnagtcatcatgccccttatacgctgggctacacacgtgctacaatgggtagcagagagtcgcaaagccgtgaggtgaagctaatctcagctattcttagttcggatgtactctgcnactcgagtacagaagttggaatcgctagtaatcgcgaatcagcaatgtcgcggtgaatacgttctcgggtcttgtacacaccgcccgtcacaccacgagagttggttgcacctgaagtag

SEQ ID NO: 918 - DNA, 1496 bp, Fusobacterium sp. D12
agagtttgatcctggctcaggatgaacgctgacagaatgcttaacacatgcaagtcgactcgagtcttcggacttgggtggcgcacgggtgagtaacgcgtaaagaacttgcctcttagaccgggacaacatctggaaacggatgctaataccggatattatggttttttcgcatggaggaatcatgaaagctagatgcgctaagagagagctttgcgtcccattagctagttggtgaggtaacggcccaccaaggcaatgatgggtagccggcctgagagggtgaacggccacaaggggactgagacacggcccttactcctacgggaggcagcagtggggaatattggacaatggaccgcaagtctgatccagcaattctgtgtgcacgatgacgtttttcggaatgtaaagtgctttcagtcgggaagaagtcagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggagctcaactccgtatggcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacgaacggagcagagatgcgccggtgccctttcgggggaacgtagtgacaggtggtgcatggctgtcgtcagctcgtgtcgtgagatgttgggttaagtcccgcaacgagcgcaacccctatcgtatgttaccatccttcagttggggactcatgcgatactgcctgcgacgagcaggaggaaggtggggatgacgtcaagtcatcatgccccttatacgctgggctacacacgtgctacaatgggtagtacagagagcagcaaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccttagggaaggatgctccgagggtgtggttagcgattggggtgaagtcgtaacaaggtatccgtacgggaacgtgcggatggatcacct

SEQ ID NO: 919 - DNA, 1362 bp, Fusobacterium sp. oral clone ASCF06
  modified_base (16)..(16): a, c, t, g, unknown or other
gagtttgattttggcncaggattaacgctgacgaatgcttaacacatgcaagtctactggtggcggacgggtgagtaacgcgtaaagaacttgcctcacagttagggacaacatttggaaacgaatgctaatacctgatattgaaaggcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacactggacaaagtctgatccagcaattcgtgtgcacgatgacgtttttcggaatgtaaagtgctttcagttgggaagatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagactgacgctaaagcgcgaaagcgtgggtagcaaacaggattagataccctggtagtccacgccgtacacgatgattactaggtgttggggactcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcgacaggtggtgcatggctgtcgtcagctcgtgtcgtgagatgttgggttaagtcccgcaacgagcgcaaccccttttgtatgttaccatcagttggggactcatgcgatactgcctgcgatgagcaggaggaaggtggggatgacgtcaagtcatcatgccccttatacgctgggctacacacgtgctacaatgggtagcagagagtcgcaaagccgcgaggtggagctaatctcagctattcttagttcggatgtactctgcaactcgagtacagaagttggaatcgctagtaatcgcgaatcagcaatgtcgcggtgaatacgttctcgggtcttgtacacaccgcccgtcacaccacgagagttggttgcacctgaagtagcagcctagggatgctccgagggtgtgattagcgattggggtgaagtcgtaacaaggtatccgtacgggaacgtgcggctggaacacctcctt

SEQ ID NO: 920 - DNA, 1558 bp, Fusobacterium sp. oral clone ASCF11
  modified_base (623)..(623): a, c, t, g, unknown or other
  modified_base (852)..(852): a, c, t, g, unknown or other
  modified_base (884)..(884): a, c, t, g, unknown or other
  modified_base (947)..(947): a, c, t, g, unknown or other
gagagtttgattctggctcaggacgaacgctggcggcgtgcctaatacatgcaagtcgaacgagagcgaccggtgcttgcactgatcaatctagtggcgaacgggtgagtaacacgtgggtaacctgcccatcagagggggataacattcggaaacggatgctaaaaccgcataggttctttagtcgcatgactgaagaaggaaaagaggcttcggcttctgctgatggatggacccgcggtgcattagctagttggtgaggtaacggctcaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaactctgttgttagagaagaacagcgcatagagtaactgttatgcgtgtgacggtatctaaccagaaagccacggctaaatacgtgccagcagcccgcggtaataccgtatgtcacaagcgttatccggatttattgggcgtaaagcgcgtctaggtggttatgtaacgtctgatgtgaaaatgcagggnctcaactctgtattgcgttggaaactgcatgactagagtactggagaggtaagcggaactacaagtgtcagaggtgaaattcgtagatatttgtaggaatgccgatggggaaagcccagcttactggacagatactgacgctaaagcgcgaaagcgtgggtagcaaacaggattagataccctgggtagtccaccccgtaaacgatgattactaggtgttgggggtcgnacctcagcgcccaagctaacgcgataagtaanaccgcctggggagtacgtacgcaagtatgaaactcaaaggaattgaccggggacccgcacaangcggtggagcatgtggtttaattcgacgcaacgcgaggaaccttaccagcgtttgacatcttaggaatgagacagagatgtttcagtgtcacttcggtgaaacgctaaagaccaggtggtgcatggctggtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggctggatcacctccttc

SEQ ID NO: 921 - DNA, 1511 bp, Fusobacterium ulcerans
ttgaacgaagagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgattgggtcgcatgatctggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttct

SEQ ID NO: 922 - DNA, 1503 bp, Fusobacterium varium
agagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgactgagtcgcatgatttggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggtttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttct

SEQ ID NO: 923 - DNA, 1535 bp, Gardnerella vaginalis
ttttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacgg

SEQ ID NO: 924 - DNA, 1557 bp, Gemella haemolysans
ttggagagtttgatcctggctcaggacgaacgctggcggcgtgcctaatacatgcaagtcgagcgaggtttttctggtgcttgcaccggaaaaacttagcggcgaacgggtgagtaacacgtaaagaacctgcctcatagactgggacaactattggaaacgatagctaataccggataacagcattaactgcatggttgatgtttaaaagttggttttgctaacactatgagatggctttgcggtgcattagctagttggtggggtaaaggcctaccaaggcgacgatgcatagccgacctgagagggtagatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtaagcaaacctcacaaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaaccttttaggagggagccggtcacggtgggacagatgattggggtgaagtcgtaacaaggtagccgtatcggaaggtgcggctggatcacctcctttct

SEQ ID NO: 925 - DNA, 1560 bp, Gemella morbillorum
tttatttggagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagactgggacaactattggaaacgatagctaataccggataacagtatttctcgcatgagagatatttaaaagttggttatgctaacactatgagatggctttgcggtgcattagctagttggtgggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatggatatgtagtaactatacatgtaagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctatggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtcagccaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttct

SEQ ID NO: 926 - DNA, 1560 bp, Gemella morbillorum; identical to SEQ ID NO: 925

SEQ ID NO: 927 - DNA, 1557 bp, Gemella sanguinis
ttggagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagacggggacaactattggaaacgatagctaataccggataacagcataaatcgcatgatatatgtttaaaagttggtttcggctaacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccctatgtctagttgccagcagtaagatggggactctagacagactgccagtgataaactggaggaaggcggggatgacgtcaaatcatcatgccccttatgacttgggctacacacgtgctacaatggataggaacaaagagaagctaactcgcgagagcaagcaaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttct

SEQ ID NO: 928 - DNA, 1403 bp, Gemella sp. WAL 1945J
cgaactttaagagtgcttgcacacttaaagttagcggcgaacgggtgagtaacacgtaaagaacctaccttatagacagggacaactattggaaacgatagctaatacctgataagaaagaaactcgcatgagagaagttcgaaagtcggagcaatctgacactataagatggctttgcggtgcattagctagttggtagggtaaaagcctaccaaggcgacgatgcatagccgacctgagagggtgatcggccacattgggactgagacacggcccagactcctacgggaggcagcagtagggaatcttccgcaatggacgcaagtctgacggagcaacgccgcgtgagtgaagaaggatttcggttcgtaaaactctgttgttagggaagaaaaaatgtataataactatatacaaaagagacggtacctaaccagaaagccacggctaactacgtgccagcagccgcggtaatacgtaggtggcaagcgttgtccggaattattgggcgtaaagcgcgcgcaggtggtttagaaagtctgatgtgaaagcccacggctcaaccgtggagggtcattggaaactaataaacttgagtgcaggagagaaaagtggaattcctagtgtagcggtgaaatgcgtagagattaggaggaacaccggtggcgaaagcggctttttggcctgcaactgacactgaggcgcgaaagcgtggggagcaaacaggattagataccctggtagtccacgccgtaaacgatgagtgctaagtgttggagtcaaaagacttcagtgctgccagcaaacgcattaagcactccgcctggggagtacgatcgcaagattgaaactcaaaggaattgacggggacccgcacaagcggtggagtatgtggtttaattcgaagcaacgcgaagaaccttaccaagtcttgacatacagtgaagatataagaaattatattgttttaatgtttacattaaacactgatacaggtggtgcatggttgtcgtcagctcgtgtcgtgagatgttgggttaagtcccgcaacgagcgcaacccttatatctagttaccagcagtaagatggggactctagatagactgccagtgacaaactggaggaaggtggggatgacgtcaaatcatcatgccccttatgacttgggctacacacgtactacaatggataggaacaaagagaagcgacctcgcaagagcaagccaacctcagaaaactattctcagttcggattgtaggctgcaactcgcctacatgaagctggaatcgctagtaatcgcgaatcagaatgtcgcggtgaatacgttcccgggtcttgtacacaccgcccgtcacaccacgagagtttgtaacacctgaagacggtggcctaaccgtaag

SEQ ID NO: 929 - DNA, 1364 bp, Gemella sp. oral clone ASCE02
  modified_base (221)..(221): a, c, t, g, unknown or other
  modified_base (729)..(729): a, c, t, g, unknown or other
gagtttgatcttggctcaggacgaacgctggcggcgtgcctaatacatgcaagtcgagcgagcggcgaacaggtgagtaacacgtaaagaaagtgcctcatagactgggacaactattggaaacgatagctaataccggataacaaaagacactatgagatggctttgcggtgcattagctagttggtggggtaaaggcttaccaaggcgacgatgcatanccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaagacggtacctaaccagaaagtcacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgactgacactgaggcgcgaaagcgtggggagcaaacaggattagataccctggtagtccacgccgtaaacgatgagtgcntagtgttggtcgatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccttatatctagttgccagcatggggactctagatagactgccagtgataaactggaggaaggtggggatgacgtcaaatcatcatgccccttatgacttgggctacacacgtgctacaatggatagcaaagagaagcgagctcgcgagagtaagcaaacctcacctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggagccggtcacggtgggacagatgattggggtgaagtcgtaacaaggtagccgtatcggaaggtgcggctggaacacctcctt

SEQ ID NO: 930 - DNA, 1362 bp, Gemella sp. oral clone ASCF04
  modified_base (823)..(823): a, c, t, g, unknown or other
  modified_base (837)..(837): a, c, t, g, unknown or other
  modified_base (845)..(845): a, c, t, g, unknown or other
  modified_base (849)..(849): a, c, t, g, unknown or other
  modified_base (1001)..(1001): a, c, t, g, unknown or other
  modified_base (1059)..(1059): a, c, t, g, unknown or other
gagtttgattatggctcaggacgaacgctggcggcgtgcctaatacatgcaagtcgagcgagcggcgaacgggtgagtaacacgtaaagaacctgcctcatagactgggacaactattggaaacgatagctaataccggataacaaaagacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggcttgttggcctgactgacactgaggcgcgaaagcgtggggagcaaacaggattagataccctggtagtccacgccgtaaacgatgagtgctaagtgttggtcgatcagtgctgcagctaacgcattaagcactccgcctggggagtacgaccgccaggttgaaactgaaaggaattcccgggganccgcacgcggtggngcatgtgntttnattcgaagcaacgcgaagaaccttaccaagtcttgacatatgcaggtggtgcatggttgtcgtcagctcgtgtcgtgagatgttgggttaagtcccgcaacgagcgcaacccttatatctagttgccagcatggggactctagatagactgncagtgataaactggaggaaggtggggatgacgtcaaatcatcatgccccttatgactngggctacacacgtgctacaatggatagcaaagagaagcgagctcgcgagagtaagcaaacctcacctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggatccggtcacggtgggacagatgattggggtgaagtcgtaacaaggtagccgtatcggaaggtgcggctggaacacctcctt

SEQ ID NO: 931 - DNA, 1340 bp, Gemella sp. oral clone ASCF12
  modified_base (140)..(140): a, c, t, g, unknown or other
  modified_base (161)..(161): a, c, t, g, unknown or other
  modified_base (331)..(331): a, c, t, g, unknown or other
  modified_base (693)..(693): a, c, t, g, unknown or other
acgctggcggcgtgcctaatacatgcaagtcgagcgagcggcgaacgggtgagtaacacgtaaagaacctgcctcatagacggggacaactattggaaacgatagctaataccggataacaaaagacactatgagatggntttgcggtgcattagctagtnggtggggtaaaggcctaccaaggcgacgatgcatagccgacctgagagggtgatcggccacactgggactgagacacggcccagactcctacgggaggcagcagtagggaatcttccgcaatgggcgaaagcctgacggagccacgccgtgtgagtgaagaaggatttcnggtcgtaaagctctgttgttagggaagaagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgactgacactgaggcgcgaaagcgtggggagcaaacaggattagataccctggtagtccacgccgtanacgatgagtgctaagtgttggtcgatcagtgctgcagctaacgcattaagcactccgcctggggagtacgaccggaaggttgaaactcaaaggaattgacggggacccgcacaagcggtggagcatgtggtttaattcgaagcaacgcgaagaaccttaccaagtcttgacatatacaggtggtgcatggttgtcgtcagctcgtgtcgtgagatgttgggttaagtcccgcaacgagcgcaacccctatgtctagttgccagcatggggactctagacagactgccagtgataaactggaggaaggcggggatgacgtcaaatcatcatgccccttatgacttgggctacacacgtgctacaatggatagcaaagagaagctaactcgcgagagcaagcaaacctcatctattctcagttcggatgtagtctgcaactcgactacagaagctggaatcgctagtaatcgcgaatcagaatgtcgcggtgaatacgttcccgggtcttgtacacaccgcccgtcacaccacgagagtttgtaacacccgaagacggtgcctagggagccggtcacggtgggacagacgattggggtgaagtcgtaacaaggtagccgtatcggaaggtgcggctggaacacctcctt

SEQ ID NO: 932 - DNA, 1367 bp, Gemmiger formicilis
  modified_base (10)..(12): a, c, t, g, unknown or other
  modified_base (1359)..(1360): a, c, t, g, unknown or other
aacggagtcnnngaggagcttgcttttcttgatttagtggcgaacgggtgagtaacgcgtgagtaacctgccctggagtgggggacaacagttggaaacgactgctaataccgcataagcccacggtgccgcatggcactgagggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgccagcagccgcggtaaaacgtagggtgcaagcgttgtccggaattactgggtgtaaagggagcgcaggcggaccggcaagttggaagtgaaatccatgggctcaacccgtgaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacaggattagataccctggtagtccatgccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagtgcagagatgcatgaagtccttcgggacatcgagacagatggtgcatggttgtcgtcagctcgtgtcgtgagatgttgggttaagtcccgcaacgagcgcaacccttattgccagttactacgcaagaggactctggcgagactgccgttgacaaaacggaggaaggtggggatgacgtcaaatcatcatgccctttatgacctgggctacacacgtactacaatggcgtttaacaaagagaagcaagaccgcgaggtggagcaaaactcagaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccggggggacccgaagtcggtagtctaaccnnaaggagg

SEQ ID NO: 933 - DNA, 1553 bp, Geobacillus kaustophilus
gagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcgggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttct

SEQ ID NO: 934 - DNA, 1517 bp, Geobacillus sp. E263
agtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagacccctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtaacc

SEQ ID NO: 935 - DNA, 1546 bp, Geobacillus sp. WCH70
agagtttgatcctggctcaggacgaacgctggcggcgtgcctaatacatgcaagtcgagcggaccgaacggaagcttgcttctgttcggttagcggcggacgggtgagtaacacgtgggtaacctgcccgtaagaccgggataactccgggaaaccggggctaataccggataacaccgaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggattaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcgggggggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgtaagggagccagccgccgaaggtggggcaagtgattggggtgaagtcgtaacaaggtagccgtaccggaaggtgcggctggatcacct

SEQ ID NO: 936 - DNA, 1523 bp, Geobacillus stearothermophilus
acgaacgctggcggcgtgcctaatacatgcaagtcgagcggaccggattggggcttgccttgattcggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatca

SEQ ID NO: 937 - DNA, 1561 bp, Geobacillus thermocatenulatus
tcttttggagagtttgatcctggctcaggacgaacgctggcggcgtgcytaatacatgcaagtcgagcggaccgaacgggagcttgctctcgtttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggyggccccttaagtctgatgtgaaagcccacggctcaaccgtggagggtcattggaaactggggggcttgagggcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttct

SEQ ID NO: 938 - DNA, 1551 bp, Geobacillus thermodenitrificans
agagtttgatcctggctcaggacgaacgctggcggcgtgcctaatacatgcaagtcgagcggaccgaacgagagcttgctcttgttcggtcagcggcggacgggtgagtaacacgtgggcaacctgcccgcaagaccgggataactccgggaaaccggagctaataccggataacaccaaagaccgcatggtctttggttgaaaggcggcttcggctgccacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaaagctctgttgtgagggacgaaggagcgccgtttgaataaggcggcgcgggggacggtacctcacgaaaaagcccccggctaactacgtgccagcagccgcggtaatacgtagggggcgagcgttgtccggaattattgggcgtaaaggggcccgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgtagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctagttgccagcattcagttgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcc

SEQ ID NO: 939 - DNA, 1562 bp, Geobacillus thermoglucosidasius
ctctttggagagtttgatcctggctcaggacgaacgctggcggcgtgcctaatacatgcaagtcgagcggaccgggcgggagcttgcttccgcttggttagcggcggacgggtgagtaacacgtgggtaacctgcccgtaagaccgggataactccgggaaaccggggctaataccggataacaccgaagaccgcatggtcttcggttgaaaggcggcttcggctgccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtgccgttcgaacagggcggcacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggcttaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttattccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcctcccttgcgggaggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttct

SEQ ID NO: 940 - DNA, 1546 bp, Geobacillus thermoleovorans
agagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacct

SEQ ID NO: 941 - DNA, 1555 bp, Geobacter bemidjiensis
aaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccttcggtctctgcaggaaaaggtggcctctatttataagctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaaatgaaaacggttaatacccgtttttcttgacggtacctacaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctccccgaaacgggagggtgccttcgggagccgcaagacaggtgctgcatggctgtcgtcagctcgtgtcgtgagatgttgggttaagtcccgcaacgagcgcaacccctatccttagttgccatcatttagttgggcactctaaggagactgccggtgtcaaaccggaggaaggtggggatgacgtcaagtcctcatggcccttatgtccagggctacacacgtgctacaatggccggtacaaagagcagcgataccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctccttt

SEQ ID NO: 942 - DNA, 1485 bp, Gloeobacter violaceus
aaaatggagagtttgatcctggctcaggatgaacgctggcggcgtgcttaacacatgcaagtcgaacgagatcttcggatcgagtggcggacgggtgagtaacacgtgggaatctgccctcaggagggggataacggccggaaacggccgctaataccccatatgccgcaaggtgaaatgaatttcgcctgaggatgagcccgcgtctgattagctagttggtggggtaatggcctaccaaggctacgatcagtagctggtctgagaggatgatcagccacactgggactgagacacggcccagactcctacgggaggcagcagtggggaattttccgcaatgggcgaaagcctgacggagcaacgccgcgtgggtgatgaaggcccgtgggtcgtaaagcccttttgtcagggacgaaacctgacggtacctgacgaataagcatcggctaactccgtgccagcagccgcggtaatacggaggatgcaagcgttatccggaattattgggcgtaaagcgtacgtaggcggccagccaagtctggggtcaaagcccgcagcctaactgcggaaaggccctggaaactggttggctagagtgcggtaggggcaaggggaattcccggtgtagcggtgaaatgtggagatatcgggaagaacaccagcggcgaaagcgccttgctggaccgcaactgacgctgaggtacgaaagccaggggagcaaatgggattagataccccagtagtcctggccgtaaacgatggacactaggtgttgcgcgtatcgacccgtgcagtgccgtagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggcttgacatgtcgcgaatctcgcggaaacgtgggagtgccttcgggaacgcgaacacaggtgctgcatggctgtcgtcagctcgtgtcgtgagatgttgggttaagtcccgcaacgagcgcaaccctcgtcgtcagttgccatcattcagttgggcactctggcgagactgccggtgacaaaccggaggaaggtggggatgacgtcaagtcagcatggctcttacgtcctgggctacacacgtgctacaatggttcggataaagggtcgcaatctcgcgagggggagccaatcccataaaccgaatctcagttcggattgcaggctgcaactcgcctgcatgaagtcggaatcgctagtaatcgcaggtcagcatactgcggtgaatacgttcccgggccttgtacacaccgcccgtcacaccatggaagctggtcatgcccgaagtcggtattctaaccgcaaggagggagccgccgaaggcggggccggtgactggggtgaagtcgtaacaaggtagccgtaccggaaggtgcggctggatcacctccttt

SEQ ID NO: 943 - DNA, 1447 bp, Gluconacetobacter azotocaptans
agcgaacgctggcggcatgcttaacacatgcaagtcgcacgaacctttcggggttagtggcggacgggtgagtaacgcgtagggatctgtccatgggtgggggataacctcgggaaactgaggctaataccgcatgacacctgagggtcaaaggcgtaagtcgcctgtggaggaacctgcgttcgattagctggttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccacgtgccgcggtaatacgaagggggctagcgttgctcggaatgactgggcgtaaagggcgcgtaggcggtttggacagtcagatgtgaaattcctgggcttaacctgggggctgcatttgatacgtacagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggtggcttagccactcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgttcagagatgagcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgggtgcatgaagttggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaactgc

SEQ ID NO: 944 - DNA, 1486 bp, Gluconacetobacter diazotrophicus
agagtttgatcctggctcagagcgaacgctggcggcatgcttaacacatgcaagtcgcacgaacctttcggggttagtggcggacgggtgagtaacgcgtagggatctgtccatgggtgggggataactccgggaaactggagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaattcctgggcttaacctgggggctgcatttgatacgtacagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggtggcttagcccctcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgcagtcagagatggctgtttcccgcaagggacctcctgcacaggtgctgcatggctgtcgtcagctcgtgtcgtgagatgttgggttaagtcccgcaacgagcgcaaccctcgcctttagttgccagcatgattgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgcggctggatcacctccttt

SEQ ID NO: 945 - DNA, 1484 bp, Gluconacetobacter entanii
  modified_base (10)..(11): a, c, t, g, unknown or other
gagtttgatnntggctcagagcgaacgctggcggcatgcttaacacatgcaagtcgcacgaacctttcggggttagtggcggacgggtgagtaacgcgtagggatctgtccatgggtgggggataaccttgggaaaccgaggctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaa

SEQ ID NO: 946 - DNA, 1482 bp, Gluconacetobacter europaeus
gagtttgatcatggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcctgggcttaacctgggggctgcatttgatacgtggcgactagagtgtgagagagggttgtggaattcccagtgtagaggtgaaattcgtagatatttgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 947 - DNA, 1481 bp, Gluconacetobacter hansenii
gagtttgattatggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtgacgactagagtgtgagagagggttgtggaattcccagtgtagaggtgaaattcgtagatattgggaagaacaccggtggcgaaggcggcaacctggctcatgactgacgctgaggcgcgaaagcgtggggtgcaaacaggattagataccctggtagtccacgctgtaaacgatgtgtgctggatgttggatggcttggccattcggtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccaggacttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctccttt

SEQ ID NO: 948 - DNA, 1447 bp, Gluconacetobacter johannae
agcgaacgctggcggcatgcttaacacatgcaagtcgcacgaacctttcggggttagtggcggacgggtgagtaacgcgtagggatctgtccatgggtgggggataacctcgggaaactgaggctaataccgcatgacacctgagggtcaaaggcgtaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaattcctgggcttaacctgggggctgcatttgatacgtatagactagagtgtgagagagggttgtggaattcccagtgtagaggtgaaattcgtagatattgggaagaacaccggtggcgaaggcggcaacctggctcataactgacgctgaggcgcgaaagggtggggagcaaacaggattagataccctggtagtccacgctgtaaacgatgtgtgctggatgttgggtggcttagccactcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtgagcagagatgttcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgggtgcatgaagttggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgc

SEQ ID NO: 949 - DNA, 1449 bp, Gluconacetobacter oboediens
tgagtttgatcctggctcagagcgaatgctggcggcatgcttaacacatgcaagtcgcacgaacctttcggggttagtggcggacgggtgagtaacgcgtagggatctatccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggatgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagc

SEQ ID NO: 950 - DNA, 1493 bp, Gluconacetobacter xylinus
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcaggtgtgaaattcccgggcttaacctggggtctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtttgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctccttt

SEQ ID NO: 951 - DNA, 1472 bp, Gordonia bronchialis
ggacgaacgctggcggcgtgcttaacacatgcaagtcgaacggaaaggcccagcttgctgggtactcgagtggcgaacgggtgagtaacacgtgggtgatctgcccctgactttgggataagcctgggaaactgggtctaataccggatatgaccttacatcgcatggtgtttggtggaaagcttttgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgtgagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtggggttcatttcacggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaacaaggtagccgtaccgg

SEQ ID NO: 952 - DNA, 1298 bp, Gordonia polyisoprenivorans
gacgaacgctggcggcgtgcttaacacatgcaagtcgaacgagtggcgaacgggtgagtaacacgtgggtgatctgcccctgactttgggataagcctgggaaactgggtctaataccggatatggaaaggcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagcagggacgatgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagactgacgctgaggagcgaaagcgtgggtagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatacaggtggtgcatggctgtcgtcagctcgtgtcgtgagatgttgggttaagtcccgcaacgagcgcaacccttgtcctgtattgccagcggccggggacttgcaggagactgccggggtcaactcggaggaaggtggggatgacgtcaagtcatcatgccccttatgtccagggcttcacacatgctacaatggccggcagagggctgcgataccgtgaggtggagcgaatcccttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccggtgcctagggagctgtcgaaggtgggatcggcgattgggacg

SEQ ID NO: 953 - DNA, 1485 bp, Gordonia sp. KTR9
  modified_base (11)..(11): a, c, t, g, unknown or other
  modified_base (415)..(415): a, c, t, g, unknown or other
  modified_base (1483)..(1483): a, c, t, g, unknown or other
agagtttgatncctggctcaggacgaacgctggcggcgtgcttaacacatgcaagtcgaacggaaaggcccagcttgctgggtactcgagtggcgaacgggtgagtaacacgtgggtgatctgccctgcactctgggataagcctgggaaactgggtctaataccggatatgaccaactgtcgcatggtggttggtggaaagcttttgcggtgtgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcggnttgtaaacctctttcaccagggacgaagcgtgagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaaccaaggtancc

SEQ ID NO: 954 - DNA, 1430 bp, Gordonia sputi
tgcaagtcgaacggaaaggcccagcttgctgggtactcgagtggcgaacgggtgagtaacacgtgggtgatctgcccctgactttgggataagcctgggaaactgggtctaataccggatattcatttttcctcgcatggggatttgtggaaagcttttgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagctccgacgaagcgcaagtgacggtaggagcagaagaagcaccggccaactacgtgccagcagccgcggtaatacgtagggtgcaagcgttgtccggaattactgggcgtaaagagctcgtaggcggtttgtcgcgtcgtctgtgaaattctgcagcttaactgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggtttcatttcacggaatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcagtcagagatggctgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgagaccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggatcggcgattgggacgaagtcgtaacaagg

SEQ ID NO: 955 - DNA, 1467 bp, Gordonia terrae
  modified_base (444)..(445): a, c, t, g, unknown or other
gagtttgatcatggctcaggacgaacgctggcggcgtgcttaacacatgcaagtcgaacggaaaggcccagcttgctgggtactcgagtggcgaacgggtgagtaacacgtgggtgatctgccctgcactctgggataagcctgggaaactgggtctaataccggatatgaccaactgtcgcatggtggttggtggaaagcttttgcggtgtgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgnnagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcggctagagatagtcgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaag

SEQ ID NO: 956 - DNA, 1497 bp, Gordonibacter pamelaeae; identical to SEQ ID NO: 680

SEQ ID NO: 957 - DNA, 1549 bp, Gracilibacter thermotolerans
cctaccatgcagtcgagcggagatttcttcggcactgaacattctagtagtatgacgcaaacaaagcgtcatgaagaaacaccattggtgtatatgataagataaaagtttcttcatcacgcgttaataaagtgccaacacaaacatcaagagaaattagagaaaagaatgtattagaatgttgagtgctgaagaaatcttagcggcggacgggtgagtaacacgtgggcaacctgcctcgaagagggggataacaccgagaaatcggtgctaataccgcataacatacacagaccgcatggtgagtgtatcaaaggagaaatccgctttgagatgggcccgcggctgattagctagttggtaaggtaacggcttaccaaggcgacgatcagtagccgacctgagagggtgaccggccacactggaactgagacacggtccagactcctacgggaggcagcagtggggaatattgcgcaatgggggaaaccctgacgcagcaacgccgcgtggaggaagaaggtcttcggattgtaaactcctgtcttctgggacgaagaatgacggtaccagaggaggaagccacggctaactacgtgccagcagccgcggtaatacgtaggtggcgagcgttgtccggaattactgggcgtaaagggcgcgtaggcggttttttaagtcagatgtgaaaacccagggcttaactctgggattgcatttgaaactggaaggcttgagtgcaggagaggtaagtggaattcctagtgtagcggtgaaatgcgtagatattaggaggaacaccagtggcgaaggcgacttactggactgtaactgacgctgaggcgcgaaagcgtggggagcaaacaggattagataccctggtagtccacgccgtaaacgatggatactaggtgtgggaggtgtcgaccccttccgtgccgcagtaaacgcaataagtatcccgcctggggagtacggccgcaaggttgaaactcaaaggaattgacgggggcccgcacaagcagcggagcatgtggtttaattcgaagcaacgcgaagaaccttaccaggacttgacatcccctgaattactcgtaacggaggaagtccttcgggacagggagacaggtggtgcatggttgtcgtcagctcgtgtcgtgagatgttgggttaagtcccgcaacgagcgcaacccctattgctagttgccatcattaagttgggcactctagtgagactgccggagacaattcggaggaaggtggggatgacgtcaaatcatcatgccccttatgttctgggctacacacgtgctacaatgggtgtaacaacgagaagcgagctagtgatagcaagccaacctctaaaaagcaccctcagttcggattgtaggctgaaacccgcctacatgaagttggagttgctagtaatcgcgaatcagcatgtcgcggtgaatacgttcccgggccttgtacacaccgcccgtcacaccatgggagttggaagcacccgaagccggtgacttaaccgcaaggagagagcctcgaag

SEQ ID NO: 958 - DNA, 1527 bp, Gramella forsetii
atgaagagtttgatcctggctcaggatgaacgctagcggcaggcctaacacatgcaagtcgaacggtaacagggattgcttgcaatccgctgacgagtggcgcacgggtgcgtaacgcgtatacaatctgcctttaagcggggaatagcccatggaaacgtggattaataccccatagtattatgatttcacctgggattataattaaacatttatggcttaaagatgagtatgcgtcctattagttagttggtaaggtaacggcttaccaagacagcgataggtaggggtcctgagagggagatcccccacactggtactgagacacggaccagactcctacgggaggcagcagtgaggaatattggacaatggaggcaactctgatccagccatgccgcgtgcaggaagacggccctatgggttgtaaactgcttttatacgggaagaaccacatctacgtgtagatgcttgacggtaccgtatgaataaggaccggctaactccgtgccagcagccgcggtaatacggagggtccaagcgttatccggaatcattgggtttaaagggtccgtaggcggaataataagtcagtggtgaaagtctgcagctcaactgtagaattgccattgatactgttgttcttgaattattatgaagtggttggaataagtagtgtagcggtgaaatgcatagatattacttagaacacctattgcgaaggcagatcactaataatatattgacgctgagggacgaaagcgtaggtagcgaacaggattagataccctggtagtctacgccgtaaacgatggttactagctgtccggcctaattgagggctgggtggttaagcgaaagtgataagtaacccacctggggagtacgttcgcaagaatgaaactcaaaggaattgacgggggcccgcacaagcggtggagcatgtggtttaattcgatgatacgcgaggaaccttaccagggcttaaatgcagtctgacaggtctggaaacagacttttcttcggacagattgcaaggtgctgcatggttgtcgtcagctcgtgccgtgaggtgtcaggttaagtcctataacgagcgcaacccctgtggttagttgccagcgagtaatgtcgggaactctagccagactgccggtgcaaaccgcgaggaaggtggggatgacgtcaaatcatcacggcccttacgtcctgggccacacacgtgctacaatggtagggacagagggcagctaccccgcgaggggatgcgaatcttcaaaccctatcacagttcggatcgcagtctgcaactcgactgcgtgaagctggaatcgctagtaatcgcatatcagccatgatgcggtgaatacgttcccgggccttgtacacaccgcccgtcaagccatggaagctgggggtacctgaagtccgtcaccgtaaggagcggcctagggtaaaactggtaactggggctaagtcgtaacaaggtagccgtaccggaaggtgcggctggaacacctcctttct

SEQ ID NO: 959 - DNA, 1548 bp, Granulicatella adiacens
atgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcggttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttct

SEQ ID NO: 960 - DNA, 1227 bp, Granulicatella elegans
gtcgaacgagtggcgaacgggtgagtaacacgtgggtaacctgcccatcagagggggataacattcggaaacggatgctaaaaccgcatagggaaaactgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaactctgttgttagagaagatgacggtatctaaccagaaagccacggctaactacgtgccagcagccgcggtaatacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctaagtgttggagcttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcgcggatcagcacgccgcggtgaatacgttcccgggtcttgtacacaccgcccgtcacaccacgagagtttgtaacacccaaagtcggtaggta

SEQ ID NO: 961 - DNA, 1512 bp, Granulicatella paradiacens
agtttgatcatggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttttggagccagccgcctaaggtgggatagatgattggggtgaagtcgtaacaaggtagccgta

SEQ ID NO: 962 - DNA, 1445 bp, Granulicatella sp. M658/99/3
  modified_base (73)..(73): a, c, t, g, unknown or other
  modified_base (180)..(180): a, c, t, g, unknown or other
acgctggcggcgtgcctaatacatgcaagtcgaacgcagtttcattcaccgagtgcttgcactcaccgaatgnactgagtggcgaacgggtgagtaacacgtgggtaacctgcccatcagtgggggataacagtcggaaacgactgctaataccgcatgattttcaacaccgcatggtgntgaaataaaagacggctttgctgtcgctgatggatggacccgcggcgtattagctagttggtgaggtaacggctcaccaaggcaatgatacgtagccggcctgagagggtaatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacaacctcttgagtaactgtaagaggtctgacggtatctaaccagaaagccacggctaactacgtgccagcagccgcggtaatacgtaggtggcaagcgttgtccggatttattgggcgtaaagcgagtgcaggcggttccttaagtctgatgtgaaagcccacggcttaaccgtggagggtcattggaaactggggaacttgagtgcagaagaggagagtggaattccatgtgtagcggtggaatgcgtagatatatggaggaacaccagtggcgaaggcgactctctggtctgtaactgacgctgaggctcgaaagcgtgggtagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttatcattagttgccagcattcagttgggcactctagtgatactgccggtgacaaaccggaggaaggtggggatgacgtcaaatcagcatgccccttatgacttgggctacacacgtgctacaatggatggtacaacgagcagcaaacccgcgagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccaaagtcggtgaggtaacccttctgggag

SEQ ID NO: 963 - DNA, 1510 bp, Granulicatella sp. oral clone ASC02
  modified_base (743)..(743): a, c, t, g, unknown or other
  modified_base (902)..(902): a, c, t, g, unknown or other
  modified_base (998)..(998): a, c, t, g, unknown or other
  modified_base (1013)..(1013): a, c, t, g, unknown or other
gagagtttgattctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatacgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaactacgtgccagcagccgcggtaatacgtatgtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtaagcggtgaaatgcgtagatatatggaggaacaccagtggcgaaggcgactctctggtctgtaactgaccgctgagcgctcgaaagcgtgggtagcaanacaggattagatacccctggtagtccacgccgtaaacgatgagtgctaagtgttggagggtttccgcccttcagtgctgcagttaccgcattaagcactccgcctggggagtacgaccgccaaggttgaaactcaaaggaattgagcggggacccgcancaagcggtggagcatgtggtttaattcgaagcaacgcgaagaaccttaccaagtcttgacatcctttgaccactctagagatagagctttcccttncggggacaaagtgancaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttaaggagccagccgcctaaggtgggatagatgattggggtgaagtcgtaacaaggtagccgtatcggaaggtgcggctggaacacctccttc

SEQ ID NO: 964 - DNA, 1327 bp, Granulicatella sp. oral clone ASCA05
  modified_base (136)..(136): a, c, t, g, unknown or other
  modified_base (159)..(160): a, c, t, g, unknown or other
  modified_base (427)..(427): a, c, t, g, unknown or other
  modified_base (702)..(702): a, c, t, g, unknown or other
tggcggcgtgcctaatacatgcaagtcgaacgagtggcgaacgggtgagtaacacgtgggtaacctgcccatcagagggggataacattcggaaacggatgctaaaaccgcatagggaaaactgctgatggatggntccgcggtgcattagctagttgnngaggtaacggctcaccaaggcgatgatgcatagccgacctgagagggtgatcggccacattgggactgagacacggcccaaactcctacgggaggcagcagtagggaatcttccgcaatggacgcaagtctgacggagcccgccgtttgagtgaagaaggatttcggttcgtaaaactctgttgttagagaccatgacggtatctaaccagaaagccacggctaactacgcgccagcagccgcggtaatacgtaggtggcaagcgtngtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctanatgttggagctacagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttggttaagtccgcaacgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcgcggatcagcacgccgcggtgaatacgttcccgggtcttgtacacaccgcccgtcacaccacgagagtttgtaacacccaaagtcggtaggtagccagccgcctaaggtgggatagatgattggggtgaagtcgtaacaaggtagccgtatcggaaggtgcggctggaacac

SEQ ID NO: 965 - DNA, 1560 bp, Granulicatella sp. oral clone ASCB09
  modified_base (887)..(887): a, c, t, g, unknown or other
  modified_base (907)..(907): a, c, t, g, unknown or other
  modified_base (993)..(993): a, c, t, g, unknown or other
  modified_base (1055)..(1055): a, c, t, g, unknown or other
gagagtttgatcatggctcaggacgaacgctggcggcgtgcctaatacatgcaagtcgaacgagaagcgaccggtgcttgcactggtcaatctagtggcgaacgggtgagtaacacgtgggtaacctgcccatcagagggggataacattcggaaacggatgctaaaaccgcataggttctttagtcgcatgactgaagaaggaaaagaggcttcggcttctgctgatggatggacccgcggtgcattagctagttggtgaggtaacggctcaccaaggcgatgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaacttctgttgttagagaagaacagcgcatagagtaactgttatgcgtgtgacggtatctaaccagaaagccacggctaactacgtgccagcagccgcggtaatacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagatacccctggtagtccacgccgtaaacgatgagtgctaagtgttggagggtttccgcccttcagtgctgcagttaacgcattaagcactccngcctgggtgagtacgaccgncaaggttgaaactcaaaggaattgacggggacccgcacaagcggtggagcatgtggtttaattcgaagcaacgcgaagaaccttanccaagtcttgacatcctttgaccactctagagatagagctttcccttcggggacaaagtgancaggtggtgcatggttgtcgtcagctcgtgtcgtgagatgttgggttaagtcccgcaacgagcagcaaaccacattattactagttgccagcattgagttgggcactctagcgagactgccaggtaacaaacccggaggaaggtggggatgacagtcaaatcatcatgccccttatgacctgggctacacacgtgctacaatggctggtacaacgagttgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggttggaacacctccttc

SEQ ID NO: 966 - DNA, 1331 bp, Granulicatella sp. oral clone ASCG05
  modified_base (1154)..(1154): a, c, t, g, unknown or other
gcgtgcctaatacatgcaagtcgaacgagtggcgaacgggtgagtaacacgtgggtaacctgcccatcagagggggataacattcggaaacggatgctaaaaccgcatagggaaaactgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagatgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgactgacgctgaggctcgaaagcgtgggtagcaaacaggattagataccctggtagtccacgccgtaaacgatgagtgctaagtgttggagcttcagtgcttcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcggcgagcgcaacccttattactagttgccagcatgggcactctagtgagactgccggtgacaaaccggaggaaggtggggatgacgtcaaatcatcatgccccttatgacttgggctacacacgtgctacaatggatggcaacgagcagcgaactcgcgagggtaagcgaatctcttccattctcagttcggatgtaggctgcaactcgcctacagaagccggaatcgctagtaatcncggatcagcacgccgcggtgaatacgttcccgggtcttgtacacaccgcccgtcacaccacgagagtttgtaacacccaaagtcggtaggtagccagccgcctaaggtgggatagatgattggggtgaagtcgtaacaaggtagccgtatcggaaggtgcggctggaacacctcctt

SEQ ID NO: 967 - DNA, 1488 bp, Grimontia hollisae
ctaattgaagagtttgatcatggctcagattgaacgctggcggcaggcctaacacatgcaagtcgagcggcagcgacatgaacaatccttcgggtgcgttcatgggcggcgagcggcggacgggtgagtaaaggctgggaacctgccctgacgagggggataaccactggaaacggtggctaataccgcataatgtcttcggaccaaagagggggactttcgggcctctcgcgtcaggatgggcccagttgggattagctggttggtggggtaaaggctcaccaaggcgacgatccctagctggtttgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagccgtgaggaaggtagcgtagttaatacctgcgttacttgacgttagcggcagaagaagcaccggctaactccgtgccagcagccgcggtaatacggagggtgcgagcgttaatcggaattactgggcgtaaagcgcatgcaggcggtctgttaagcaagatgtgaaagccccgggcttaacctgggagtggcattttgaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgctgtaaacgatgtctacttggaggctgtggtctagaaccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatcctcagaagccggaagagattctggtgtgccttcgggaactgagagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggtgcatacagagggcagcgagaccgcgaggtggagcgaatcccagaaagtgcatcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggt

SEQ ID NO: 968 - DNA, 1425 bp, Haematobacter sp. BC14248
cgaacgctggcggcaggcctaacacatgcaagtcgagcggggacttcggtcctagcggcggacgggtgagtaacgcgtgggaacgtgccctttgcttcggaatagccccgggaaactgggagtaataccggatgagccctttgggggaaagatttatcggcgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcaccggggaagataatgacggtacccggagaagaagccccggctaactccgtgctagcagccgcggtaatacggagggggctagcgttgttcggaattactgggcgtaaagcgcacgtaggcggatcggtaagtcagaggtgaaatcccggggctcaaccccggaactgcctttgaaactcccggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggcgtcgcgggaccagagatggttctttcagttcggctggacgccacacaggtgctgcatggctgtcgtcagctcgtgtcgtgagatgttcggttaagtccggcaacgagcgcaacccacactcccagttgccatcattcagttgggcactctgggagaactgccgatgataagtcggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggggaagtcgtaacaaggtggccgtaggggaacctgcggttg

SEQ ID NO: 969 - DNA, 1543 bp, Haemophilus aegyptius
ttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtagtgtcgagagacgaaagtgcgggactgagaggccgcatgccataggatgagcccaagtgggattaggtagttggtggggtaaaggtctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttggggtttaactctggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttac

SEQ ID NO: 970 - DNA, 1544 bp, Haemophilus ducreyi
ttaaattgaagagtttgatcatggctcagattgaacgctggcggcaggcttaacacatgcaagtcgaacggtagcacgaaggggcttgctccttgggtgacgagtggcggacgggtgagtaatgcttgggaatctggcttatggagggggataactacgggaaactgtagctaataccgcgtaatatcttcggattaaagggtgggaccttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatgggggaaaccctgatgcagccatgccgcgtgaatgaagaaggccttcgggttgtaaagttctttcggtgatgaggaaggcagttttgttaatagcaaaattgattgacgttagtcacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatatactgacgctcatgtgcgaaagcgtggggagcaaacaggattagataccctggtagtccacgctgtaaacgatgtcgatttgggggttggtctttaagactggcgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatagaagaactcagagatgagtttgtgccttcgggaactatgtgacaggtgctgcatggctgtcgtcagctcgtgttgtgaaatgttgggttaagtcccgcaacgagcgcaacccttatcctttgttgccagcatgtagtgatgggaactcaaaggagactgccagtgataaactggaggaaggtggggatgacgtcaagtcatcatggcccttacgagtagggctacacacgtgctacaatggcgtatacagagggcggcaaacctgcaaaggggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggagggcgtttaccacggtatgattcatgactggggtgaagtcgtaacaaggtaaccgtaggggaacctgcggttggatcacctccttac

SEQ ID NO: 971 - DNA, 1281 bp, Haemophilus genomosp. P2 oral clone MB3_C24
caggcttaacacatgcaagtcgaacgagtggcggacgggtgagtaatgcttgggaatctggcttatggagggggataacgacgggaaactatcgctaataccgcgtagtgaaagatgccataggatgagcccaagtgggattaggtagttggtggggtaaaggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggatgacgttaatcacagaagaagcaccggctaactccgtgccagcagccgcggtaatacggaggatgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaacgttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggcgacgaagccgcgaggtggagtgaatctcactacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtg

SEQ ID NO: 972 - DNA, 1296 bp, Haemophilus genomosp. P3 oral clone MB3_C38
attgaacgctggcggcaggcttaacacatgcaagtcgaacgagtggcggacgggtgagtaatgcttgggaatctggcttatggagggggataacgacgggaaactgtcgctaataccgcgtagagaaagatgccataggatgagcccaagtgggattaggtagttggtggggtaatagcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtattgaggatgacgttaaatacagaagaagcaccggctaactccgtgccagcagccgcggtaatacggagggtgcgagcgttaatcggaataactgggcgtaaagggcacgcaggcggacttttaagtgaggtgtgaaatccccgggcttaacctgggaattgcatttcagactgggagtctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggcgacgaagccgcgaggtggagtgaatctcactacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtg

SEQ ID NO: 973 - DNA, 1486 bp, Haemophilus haemolyticus
gctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgtagctaataccgcgtagtgtcgagagacgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggagtgtatgttaatagcatacattattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttaaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaattctgtagagatacgggagtgccttcgggaaccatgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcgtatacagagggtggcgaaactgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaac

SEQ ID NO: 974 - DNA, 1544 bp, Haemophilus influenzae
ttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagcacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttact

SEQ ID NO: 975 - DNA, 1424 bp, Haemophilus parahaemolyticus
cccaatgcaagtcgaacggtaacagggattagcttgctaatttgctgacgagtggcggacgggtgagtaatgcttgggaatctggcttatggagggggataactacgggaaactgtagctaataccgcgtaaaatcttcggattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggttgataggttaatagcctatcaaattgacgttaatcacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttgagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgagtagggctacacacgtgctacaatggcgtatacagagggaagcgagcctgcgagggggagcaaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggagggcgttacccacggtagat

SEQ ID NO: 976 - DNA, 1543 bp, Haemophilus parainfluenzae
ttgaattgaagagtttgatcatggctcagattgaacgctggcggcaggcttaacacatgcaagtcgaacggtaacatgaagaagcttgcttctttgatgacgagtggcggacgggtgagtaatgcttgggaatctagcttatggagggggataactacgggaaactgtagctaataccgcgtagtatcggaagatgaaagtgtgggaccttcgggccacatgccataggatgagcccaagtgggattaggtagttggtgaggtaaaggctcaccaagccgacgatctctagctggtctgagaggatgaccagccacactgggactgagacacggcccagactcctacgggaggcagcagtggggaatattgcgcaatgggggcaaccctgacgcagccatgccgcgtgaatgaagaaggccttcgggttgtaaagttctttcggtagcgaggaaggcatttagtttaatagactaggtgattgacgttaactacagaagaagcaccggctaactccgtgccagcagccgcggtaatacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgagctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaacattccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggaagcgagagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttac

SEQ ID NO: 977 - DNA, 1471 bp, Haemophilus paraphrophaemolyticus
  modified_base (16)..(16): a, c, t, g, unknown or other
  modified_base (29)..(29): a, c, t, g, unknown or other
  modified_base (50)..(50): a, c, t, g, unknown or other
  modified_base (81)..(81): a, c, t, g, unknown or other
  modified_base (85)..(85): a, c, t, g, unknown or other
  modified_base (132)..(132): a, c, t, g, unknown or other
  modified_base (366)..(366): a, c, t, g, unknown or other
  modified_base (368)..(368): a, c, t, g, unknown or other
  modified_base (478)..(478): a, c, t, g, unknown or other
  modified_base (488)..(488): a, c, t, g, unknown or other
  modified_base (497)..(497): a, c, t, g, unknown or other
  modified_base (499)..(500): a, c, t, g, unknown or other
  modified_base (505)..(505): a, c, t, g, unknown or other
  modified_base (624)..(624): a, c, t, g, unknown or other
  modified_base (653)..(653): a, c, t, g, unknown or other
  modified_base (666)..(666): a, c, t, g, unknown or other
  modified_base (785)..(785): a, c, t, g, unknown or other
  modified_base (838)..(838): a, c, t, g, unknown or other
  modified_base (959)..(959): a, c, t, g, unknown or other
  modified_base (1084)..(1084): a, c, t, g, unknown or other
  modified_base (1161)..(1161): a, c, t, g, unknown or other
  modified_base (1262)..(1262): a, c, t, g, unknown or other
  modified_base (1452)..(1452): a, c, t, g, unknown or other
tgaagagtttgatcanggctcagattgancgctggcggcaggcttaacanatgcaagtcgaacggtaacagggattagctngctnattgctgacgagtggcggacgggtgagtaatgcttgggaatctggcntatggagggggataactacgggaaactgtagctaataccgcgtaatatcggaagattaaagggtgggactttcgggccacctgccataagatgagcccaagtgggattaggtagttggttaggtaaaggctgaccaagccgacgatctctagctggtctgagaggatgaccagccacactggaactgagacacggtccagactcctacgggaggcagcagtggggaatattgcncnatggggggaaccctgatgcagccatgccgcgtgaatgaagaaggccttcgggttgtaaagttctttcggtgacgaggaaggttgataggttaatagcctatcaaattgangttaattacngaagaagcncnngctanctccgtgccagcagccgcggtaatacggagggtgcgagcgttaatcggaataactgggcgtaaagggcacgcaggcggtgacttaagtgagatgtgaaagccccgggcttaacctgggnattgcatttcatactgggtcgctagagtnctttagggagggntagaattccacgtgtagcggtgaaatgcgtagagatgtggaggaataccgaaggcgaaggcagccccttgggaatgtactgacgctcatgtgcgaaagcgtggggagcaaacaggattngataccctggtagtccacgctgtaaacgatgtcgatttggggattgggctttnagcttggtgcccgtagctaacgtgataaatcgaccgcctggggagtacggccgcaaggttaaaactcaaatgaattgacgggggccgcacaagcggtggagcatgtggtttaattcgatgnaacgcgaagaaccttacctactcttgacatccatggaatcttgtagagatacgagagtgccttcgggaaccatgagacaggtgctgcatggctgtcgtcagctcgtgttgtgaaatgttgggttnagtcccgcaacgagcgcaacccttatcctttgttgccagcggtttggccgggaactcaaaggagactgccagtgatnaactggaggaaggtggggatgacgtcaagtcatcatggcccttacgagtagggctacacacgtgctacaatggcgtatacagagggaagcaatcctgcganggggagcaaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggngtttaccacggtatgattc

SEQ ID NO: 978 - DNA, 1394 bp, Haemophilus parasuis
taacacatgcaagtcgaacggtagcaggaagaagcttgcttctttgctgacgagtggcggacgggtgagtaatgcttgggaatctggcttatggagggggataactacgggaaactgtagctaataccgcgtagtatcttcagatgaaagggtgggaccgcaaggccagttgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtagtgttttaatagaacattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttgtgccttcgggaacttagagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggtgcatacagagggtgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagct

SEQ ID NO: 979 - DNA, 1543 bp, Haemophilus somnus
ttaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgaggtgtgaaatccccgggcttaacctgggaacagcatttcagactgggtgactagagtactttagggaggggtagaattccacgtgtagcggtgaaatgcgtagagatgtggaggaataccgaaggcgaaggcagccccttgggaagatactgacgctcgagtgcgaaagcgtggggagcaaacaggattagataccctggtagtccacgctgtaaacgatgtcgatttggggattgggtgaacacttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagccgccagagatggtggtgtgcctacgggagcttagagacaggtgctgcatggctgtcgtcagctcgtgttgtgaaatgttgggttaagtcccgcaacgagcgcaacccttatcctttgttgccagcatgttagggtgggaactcaaaggagactgccggtgataaactggaggaaggtggggatgacgtcaagtcatcatggcccttacgagtagggctacacacgtgctacaatggcgtatacagagggaggcgagcctgcgagggtaagcgaagctcagaaagtacgtctaagtccggattggagtctggaactcgactccatgaagtcggaatcgctagtaatcgcggatcagaatgtcgcggtgaatacgttcccgggccttgtacacaccgcccgtcacaccatgggagtgggttgtaccagaagtagatagcttaacgaaagggggcgtttaccacggtatggttcatgactggggtgaagtcgtaacaaggtaaccgtaggggaacctgcggttggatcacctcctta

SEQ ID NO: 980 - DNA, 1393 bp, Haemophilus sp. 70334
gcaagtcgaacggtagcaggagaaagcttgctttcttgctgacgagtggcggacgggtgagtaatgcttgggaatctggcttatggagggggataactacgggaaactgtagctaataccgcgtaatatcgaaagattaaagtgtgggaccttcgggccacatgccatgggatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcttattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggtggcgaaactgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgc

SEQ ID NO: 981 - DNA, 1513 bp, Haemophilus sp. HK445
agagtttgatcatggctcagattgaacgctggcggcaggcttaacacatgcaagtcgaacggtaacaggrgaaagcttgctttcttgctgacgagtggcggacgggtgagtaatgcttgggaatctggcttacggagggggataactgcgggaaactgcagctaataccgcgtaatatcttaggattaaagggggcrtttgctccagccgtgagatgagcccaagtgggattaggtagttggtgaggtaatggctcaccaagcctgcgatctctagctggtctgagaggatggccagccacaccgggactgagacacggcccggactcctacgggaggcagcagtggggaatattgcgcaatggggggaaccctgacgcagccatgccgcgtgaatgaagaaggccttcgggttgtaaagttctttcggtgacgaggaaggtacttaggttaataccctaagyaattgacgttaatcacagaagaagcaccggctaactccgtgccagcagccgcggtaatacggagggtgcgagcgttaatcggaataactgggcgtaaagggcacgcaggcggatttttaagtgaggtgtgaaagcccckggcttaacctgggaattgcatttcagactgggaatctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttgggggttgggctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaagagactagagatagtcttgtgccttcgggagctttgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcgaagcagcgatgtggagcgaatctcataaagtgcgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggct

SEQ ID NO: 982 - DNA, 1361 bp, Haemophilus sp. oral clone ASCA07
  modified_base (1337)..(1337): a, c, t, g, unknown or other
gagtttgatcatggctcagattgaacgctggcggcaggcttaacacatgcaagtcgaacgagtggcggacgggtgagtaatgcttgggaatctggcttatggagggggataactacgggaaactgtagctaataccgcgtagtgaaagatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggatgacgttaaatacagaagaagcaccggctaactccgtgccagcagccgcggtaatacggagggtgcgagcgttaatcggaataactgggcgtaaagggcacgcaggcggttatttaagtgaggtgtgaaagcccccggcttaacctgggaattgcatttcagacgggataactagagtactttagggaggggtagaatcccacgtgtagcggtgaaatgcgtagagatgtggaggaatacccggggcgaaggcagccccttgggaatactgacgctcatgtgcgaaagcgtggggagcaaacaggattagataccctggtagtccacgctgtaaacgctgtcgatttggggattgggcttggtgcccgtagctaacgtgataaatcgaccgcctggggagtacggccgcaaggttaaaactcaaatgaattgaccggggcccgcacaagccgtggagcatgtggtttaattcgatgcaacgcgaagaaccttacctactcttgacatcgacaggtgctgcatggctgtcgtcagctcgtgttgtgaaatgttgggttaagtcccgcaacgagcgcaaccttatcctttgttgccagcgatcgggaactcaaaggagactgccgtgataaacggaggaaggtgggatgacgtcaagtcatcatggcccttacgagtagggctacacacgtgctacaatggcgtacagagggtggcgaaactgcgaggtggagcgaatctcagtacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaaccgtagggnaacctgcggctggatcacctcctt

SEQ ID NO: 983 - DNA, 1329 bp, Haemophilus sp. oral clone ASCG06
  modified_base (579)..(579): a, c, t, g, unknown or other
gagtttgattatggctcagattgaacgctggcggcaggcttaacacatgcaagtcgaacgagtggcgaacgggtgagtgatgcttgggaatctggcttatggagggggataactacgggaaactgtagctaataccgcgaggtgaaagatgccatgggatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaagccttcgggtgtaaagttctttcggtattgaggatgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaatnccacgtgtagcggtgaaatgcgtagagatgtggaggaataccgaaggcgaaggcagccccttgggaatactgacgcacaagtgccaaagcgtggggagcaaacaggattagataccctggtagtccacgctgtaaacgtgccgatttggggattgggcttggtccccgtagctaacgtgataatcgaccgcctggggagtacggccgcaaggttaaaacccaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccagtgataaactggaggaaggtggggatgacgtcaagtcatcatggcccttacgagtagggctacacacgtgctacaatggcgtacagagggtggcgaagctgcgaggtggagcgaatctcagtacgtctaagtccggatggagtctgcaactcgactccagaagtcggaatcgctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaac

SEQ ID NO: 984 - DNA, 1536 bp, Haemophilus sp. oral clone BJ021
ttaagagtttgatcatggctcagattgaacgctggcggcaggcttaacacatgcaagtcgaacggtaacagggattagcttgctaatttgctgacgagtggcggacgggtgagtaatgcttgggaatctggcttatggagggggataactacgggaaactgtagctaataccgcgtaaaatcttcggattaaagggtgggactttcgggccacctgccatgagatgagcccaagtgggattaggtagttggttaggtaaaggctgaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggttggtatgttaatagcatatcaaattgacgttaatcacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacagagggaagcaatcctgcgagggggagcaaatctcagaaagtgcgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggctggaacacctccttc

SEQ ID NO: 985 - DNA, 1533 bp, Haemophilus sp. oral clone BJ095
agagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgcagctaataccgcgtagtatcggaagatgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggagtgtatgttaatagcatacattattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaaaaaccttacctactcttgacatccatggaatcctgtagagatacgggagtgccttcgggaaccatgagacaggtgctgcatggctgtcgtcagctcgtgttgtgaaatgttgggttaagtcccgcaacgagcgcaacccttatcctttgttgccagcgatccggtcgggaactcaaaggagactgccagtgataaactggaggaaggtggggatgacgtcaagtcatcatggcccttacgagtagggctacacacgtgctacaatggcgtatacagagggtggcgatgccgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagacagcttaaccgcaaggggggcgtttaccacggtatgattcatgactggggtgaagtcgtaacaaggtaaccgtargggaacctgcggctggatcacctccttc

SEQ ID NO: 986 - DNA, 1364 bp, Haemophilus sp. oral clone JM053
gagtttgatcatggctcagattgaacgctggcggcaggcttaacacatgcaagtcgaacgagtggcggacgggtgagtaatgcttgggaatctggcttatggagggggataacgacgggaaactgtcgctaataccgcgtagagaaagatgccatgagatgagcccaagtgggattaggtagttggtggggtaaaggcctaccaagccgacgatctctagctggtctgagaggatgaccagccacaccgggactgagacacggcccggactcctacgggaggcagcagtggggaatattgcgcaatgggggcaaccctgacgcagccatgccgcgtgaatgaagaaggccttcgggttgtaaagttctttcggtgacgaggatgacgttaatcacagaagaagcaccggctaactccgtgccagcagccgcggtaatacggagggtgcgagcgttaatcggaataactgggcgtaaagggcacgcaggcggctatttaagtgaggtgtgaaatccccgggcttaacctgggaattgcatttcagactgggtagctagagtactttagggaggggtagaattccacgtgtagcggtgaaatgcgtagagatgtggaggaataccgaaggcgaaggcagccccttgggaatactgacgctcatgtgcgaaagcgtggggagcaaacaggattagataccctggtagtccacgctgtaaacgctgtcgatttggggattgggcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcgatcgggaactcaaaggagactgccggtgataaaccggaggaaggtggggatgacgtcaagtcatcatggcccttacgagtagggctacacacgtgctacaatggcgtacagagggtgacgaagccgcgaggtggagtgaatctcagtacgtctaagtccggatggagtctgcaactcgactccagaagtcggaatcctagtaatcgcgaatcagaatgtcgcggtgaatacgttcccgggccttgtacacaccgcccgtcacaccatgggagtgggttgtaccagaagtagatgcttagggcgtttaccacggtatgattcatgactggggtgaagtcgtaacaaggtaaccgtaggggaacctgcggttggatcacctcctt

SEQ ID NO: 987 - DNA, 1528 bp, Haemophilus sp. oral taxon 851
agagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataactacgggaaactgtagctaataccgcgtagtatcggaagatgaaagtgcgggaccgcaaggccgcatgccatgagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttaaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgatttggtcgggaactcaaaggagactgccagtgataaactggaggaaggtggggatgacgtcaagtcatcatggcccttacgagtagggctacacacgtgctacaatggcgtatacagagggtggcgaagctgcgaggtggagcgaatctcagaaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggttggatcacct

SEQ ID NO: 988 - DNA, 1522 bp, Haemophilus sputorum
agagtttgatcatggctcagattgaacgctggcggcaggcttaacacatgcaagtcgaacggtaacaggaagaaagcttgctttctttgctgacgagtggcggacgggtgagtaatgcttgggaatctggcttatggagggggataactacgggaaactgtagctaataccgcgtaatatcgagagattaaagggtgggaccgcaaggccacctgccatgagatgagcccaagtgggattaggtagttggtgaggtaaaggctcaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggcatttagtttaatagactagatgattgacgttaactacagaagaagcaccggctaactccgtgccagcagccgcggtaatacggggggtgcgagcgttaatcggaataactgggcgtaaagggcacgcaggcggtgacttaagtgagatgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgggctttaagcttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggaagcaatcctgcgagggggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttg

SEQ ID NO: 989 - DNA, 1421 bp, Hafnia alvei
  modified_base (421)..(421): a, c, t, g, unknown or other
  modified_base (538)..(538): a, c, t, g, unknown or other
  modified_base (1359)..(1359): a, c, t, g, unknown or other
catgcaagtcgagcggtagcacaagagagcttgctctctgggtgacgagcggcggacgggtgagtaatgtctgggaaactgcctgatggagggggataactactggaaacggtagctaataccgcatgacgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttngtgattgacgttactcgcagaagaagcaccggctaactccgtgccagcagccgcggtaatacggagggtgcaagcgttaatcggaattactgggcgtaaagcgcacgcaggcggttngttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacancatgggagtgggttgcaaaagaagtaggtagcttaaccttcgggagggcgcttaccactttg

SEQ ID NO: 990 - DNA, 1533 bp, Halomonas elongata
agagtttgatcatggctcagattgaacgctggcggcaggcctaacacatgcaagtcgagcggaaacgatcctagcttgctaggaggcgtcgagcggcggacgggtgagtaatgcataggaatctgcccggtagtgggggataacttgaggaaactcaagctaataccgcatacgccctacgggggaaagcaggggctcttcggaccttgcgctatcggatgagcttatgtcggattagctggttggtgaggtaacggctcaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggccctcgggttgtaaagcactttcagcgaggaagaatgcttgtcggttaatacccggcaagggagacatcactcgcagaagaagcaccggctaactccgtgccagcagccgcggtaatacggagggtgcgagcgttaatcggaattactgggcgtaaagcgtgcgtaggcggcttgataagccggttgtgaaagccccgggctcaacctgggaacggcatccggaactgttaggctagagtgcaggagaggaaggtagaattcccggtgtagcggtgaaatgcgtagagatcgggaggaataccagtggcgaaggcggccttctggactgacactgacgctgaggtacgaaagcgtgggtagcaaacaggattagataccctggtagtccacgccgtaaacgatgtcgactagccgttggggtcctcgagacctttgtggcgcagttaacgcactaagtcgaccgcctggggagtacggccgcaaggttaaaactcaaatgaattgacgggggcccgcacaagcggtggagcatgtggtttaattcgatgcaacgcgaagaaccttacctacccttgacatcgtgcgaactttccagagatggattggtgccttcgggagcgcacagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaatgggttgcaaagcggcgacgtggagctaatctcataaagccggtctcagtccggatcggagtctgcaactcgactccgtgaagtcggaatcgctagtaatcgtgcatcagaatggcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaat

SEQ ID NO: 991 - DNA, 1296 bp, Halomonas johnsoniae
attgaacgctggcggcaggcctaacacatgcaagtcgagcgagcggcggacgggtgagtaatgcataggaatctgcccgatagtgggggataacctggggaaacccaggctaataccgcatacggaaagccgctatcggatgagcctatgtcggattagctagttggtgaggtaaaggctcaccaaggcgacgatccgtagctggtctgagaggatgatcagccacatcgggactgagacacggcccgaactcctacgggaggcagcagtggggaatattggacaatggggggaaccctgatccagccatgccgcgtgtgtgaagaaggccctcgggttgtaaagcactttcagtgaggaagaagacatcactcacagaagaagcaccggctaactccgtgccagcagccgcggtaatacggagggtgcgagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgactgacactgaggtgcgaaagcgtgggtagcaaacaggattagataccctggtagtccacgccgtaaacgatgtcgaccagccgttgggtactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgtaacgagcgcaacccttgtccttatttgccagcgcgcgggaactctaaggagactgccggtgacaaaccggaggaaggtggggacgacgtcaagtcatcatggcccttacgagtagggctacacacgtgctacaatggtcggcaaagggttgccaactcgcgagagtgagccaatcccgaccgatctcagtccggacggagtctgcaactcgactccggaagtcggaatcgctagtaatcgtggatcagaatgccacggtgaatacgttcccgggccttgtacacaccgcccgtcacaccatgggagtggactgcaccagaagtggttgcctagggcgatcaccacggtgtggttcatgactggggtg

SEQ ID NO: 992 - DNA, 1430 bp, Halorubrum lipolyticum
aggccattgctattgggattcgatttagccatgctagtcgcacgagttcagactcgtggcgaatagctcagtaacacgtggccaaactacccttcggagcacaataccctcgggaaactgaggctaatagtgcataccacagtccacctggaatgaggactgtgccaaacgctccggcgccgaaggatgtggctgcggccgattaggtagacggtggggtaacggcccaccgtgccaataatcggtacgggtcatgagagtgagaacccggagacggaatctgagacaagattccgggccctacggggcgcagcaggcgcgaaacctttacactgcacgccagtgcgataagggaatcccaagtgcgtaggcatagagcctacgcttttgtccaccgtagggaggtggacgaataagggctgggcaagaccggtgccagccgccgcggtaataccggcagcccgagtgatggccgatcttattgggcctaaagcgtccgtagctggccgcacaagtccatcggaaaatccacccgctcaacgggtgggcgtccggtggaaactgtgtggcttgggaccggaaggcgcgacgggtacgtccggggtaggagtgaaatcccgtaatcctggacggaccgccgatggcgaaagcacgtcgcgaggacggatccgacagtgagggacgaaagccagggtctcgaaccggattagatacccgggtagtcctggccgtaaacaatgtctgttaggtgtggctcccactacgagtgggtgctgtgccgtagggaagccgctaaacagaccgcctgggaagtacgtccgcaaggatgaaacttaaaggaattggcgggggagcactacaaccggaggagcctgcggtttaattggactcaacgccggacatctcaccagcatcgactgtaataatgacgatcaggttgatgaccttatccgagtttcagagaggaggtgcatggccgccgtcagctcgtaccgtgaggcgtcctgttaagtcaggcaacgagcgagacccgcatccttacttgccagcagcactgcgaagtggctggggacagtagggagaccgccgtggccaacacggaggaaggaacgggcaacggtaggtcagtatgccccgaatgtgctgggcaacacgcgggctacaatggtcgagacaaagggttccaactccgaaaggagacggtaatctcagaaactcgatcgtagttcggattgtgggctgcaactcgcccacatgaagctggattcggtagtaatcgcgtgtcacaagcgcgcggtgaatacgtccctgctccttgcacacaccgcccgtcaaagcacccgagtgaggtccggatgaggcgcgtcacacgcgtcgaatctgggcttcgcaagggggcttaagtcgtaacaaggtagccgtaggggaat

SEQ ID NO: 993 - DNA, 1506 bp, Helicobacter bilis
tttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaaccttacctaggcttgacattgatagaatccgctagagatagtggagtgctggcttgccagagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggacatacaaaaagatgcaataccgcgaggtggagcaaatctctaaaatgtctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttctagaga

SEQ ID NO: 994 - DNA, 1499 bp, Helicobacter canadensis
ttctatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagattatgacggtatctaacgaataagcaccggctaactccgtgccagcagccgcggtaatacggagggtgcaagcgttactcggaatcactgggcgtaaagagcgcgtaggcggggtagcaagtcagatgtgaaatcctatggcttaaccatagaactgcatttgaaactgttactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctactagagatagtggagtgcccttttagggagcttgaaaacaggtgctgcacggctgtcgtcagctcgtgtcgtgagatgttgggttaagtcccgcaacgagcgcaaccctcgtccttagttgctagcagtttggctgagcactctaaggagactgccttcgtaaggaggaggaaggtgaggatgacgtcaagtcatcatggcccttacgcctagggctacacacgtgctacaatggggtgcacaaagagaagcaatactgcgaagtggagccaatctctaaaacatctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcggaatactaaactagttaccgcccacggcggatgcagcgactggggtgaagtcgtaacaaggtaaccgtaggtgaacctgcggttggatcacctcctttc

SEQ ID NO: 995 - DNA, 1502 bp, Helicobacter cinaedi
ttttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgcaagcgttactcggaatcactgggcgtaaagagtgcgtaggcgggtagtcaagtcagatgtgaaatcctgtagcttaactacagaactgcatttgaaactgactatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgagtatacgcgaagaaccttacctaggcttgacattgatagaatccgctagagatagtggagtgttggcttgccagagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggacatacaaaaagatgcaatatcgcgagatggagcaaatctctaaaatgtctctcagttcggattgtagtctgcaactcgactacataaagctggaatcgctagtaatcgcaaatcagcaatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttct

SEQ ID NO: 996 - DNA, 1508 bp, Helicobacter pullorum
ttttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggggtagtaagtcagatgtgaaatcctatggcttaaccatagaactgcatttgaaactactactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgatgatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggatgacgtcaagtcatcatggcccttacgcctagggctacacacgtgctacaatggggtgtacaaagagaagcaatactgcgaagtggagccaatctctaaaacatctctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagtcggaatactaaactagttaccgcccacggcggatgcagcgactggggtgaagtcgtaacaaggtaaccgtaggtgaacctgcggttggatcacctcctttcaagagaaa

SEQ ID NO: 997 - DNA, 1550 bp, Helicobacter pylori
atcaaaaaacaaaagagctttaggacaaacacttttatggagagtttgatcctggctcagagtgaacgctggcggcgtgcctaatacatgcaagtcgaacgatgaagctttctagcttgctagaaggctgattagtggcgcacgggtgagtaacgcataggtcatgtgcctcttagtttgggatagccattggaaacgatgattaataccagatactccctacgggggaaagatttatcgctaagagatcagcctatgtcctatcagcttgttggtaaggtaatggcttaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggatagtcagtcaggtgtgaaatcctatggcttaaccatagaactgcatttgaaactactattctagagtgtgggagaggtaggtggaattcttggtgtaggggtaaaatccgtagagatcaagaggaatactcattgcgaaggcgacctgctggaacattactgacgctgattgcgcgaaagcgtggggagcaaacaggattagataccctggtagtccacgccctaaacgatggatgctagttgttggagggcttagtctctccagtaatgcagctaacgcattaagcatcccgcctggggagtacggtcgcaagattaaaactcaaaggaatagacggggacccgcacaagcggtggagcatgtggtttaattcgaagatacacgaagaaccttacctaggcttgacattgagagaatccgctagaaatagtggagtgtctggcttgccagaccttgaaaacaggtgctgcacggctgtcgtcagctcgtgtcgtgagatgttgggttaagtcccgcaacgagcgcaaccccctttcttagttgctaacaggtcatgctgagaactctaaggatactgcctccgtaaggaggaggaaggtggggacgacgtcaagtcatcatggcccttacgcctagggctacacacgtgctacaatggggtgcacaaagagaagcaatactgcgaagtggagccaatcttcaaaacatctctcagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaattggctactgcccacggcacacacagcgactggggtgaagtcgtaacaaggtaaccgtaggtgaacctgcggttggatcacctcctttctagagaaaagc

SEQ ID NO: 998 - DNA, 1456 bp, Helicobacter sp. None
tagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactggatactccctgcgggggaaaggtttttcgctagaggatcagcctatgtcctatcagcttgttggtgaggtaatggctcaccaagactatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgtaagcgttactcggaatcactgggcgtaaagagtgcgtaggcgggtagtcaagtcagatgtgaaatcctgtagcttaactacagaactgcatttgaaactgactatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgttagcagctcggctgagcactctaaggagactgccttcgcaaggaggaggaaggtgaggacgacgtcaagtcatcatggcccttacgcctagggctacacacgtgctacaatgggacatacaaaaagatgcaatatcgcgagatggagcaaatctctaaaatgtctctcagttcggattgtagtctgcaactcgactacataaagctggaatcgctagtaatcgcaaatcagcaatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtgtcatagttgttt

SEQ ID NO: 999 - DNA, 1507 bp, Helicobacter winghamensis
ttttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaataccggatattccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggataataagtcagatgtgaaatcctatggcttaaccatagaactgcatttgaaactattattctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgctagcttgctagaacttgaaaacaggtgctgcacggctgtcgtcagctcgtgtcgtgagatgttgggttaagtcccgcaacgagcgcaaccctcgtccttagttgctaactattcggtagagcactctaaggagactgccttcgtaaggaggaggaaggtgaggatgacgtcaagtcatcatggcccttacgcctagggctacacacgtgctacaatggtatgtacaaagagaagcaataccgcgaggtggagcaaatctataaaacatatctcagttcggattgtagtctgcaactcgactacatgaagctggaatcgctagtaatcgcaaatcagcaatgttgcggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttcaagaga

SEQ ID NO: 1000 - DNA, 1510 bp, Heliobacterium modesticaldum
gatcctggctcaggacgaacgctggcggcatgcctaacacatgcaagtcgaacggagagctgaagtttcgatggaggctcttagtggcggacgggtgagtaacgcgtggataacctgcctgagagtgggggataacagcccgaaagggctgctaataccgcataacgttgtccggggacatccccggataaccaaaggagcaatccgctgtcagatgggtccgcgtccgattagctagttggcggggtaagagcccaccaaggcaacgatcggtagccggcctgagagggtgaacggccacactgggactgagacacggcccagactcctacgggaggcagcagtggggaatcttccgcaatgggcgaaagcctgacggagcaatgccgcgtgggggacgaaggtcttcggattgtaaacccttgtcttcagggaagaagaatgacggtacctgaggaggaagccccggctaactacgtgccagcagccgcggtaatacgtagggggcgagcgttgtccggaattactgggcgtaaagcgcgtgcaggcggacctttaagtctgaggtgaaagaccggagctcaactccggggcggccttggaaactggaggtcttgagggatggagaggacagtggaattcccggtgtagcggtgaaatgcgtagatatcgggaggaaccccagtggcgaaggcgactgtctggacattacctgacgctgaggcgcgaaagcgtggggagcaaacaggattagataccctggtagtccacgccgtaaacgatgagtgctaggtgttgggggtatcgacccctccagtgccgcagtcaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctccgaaccttgcagagatgcgagggtgcccttcggggagcggagagacaggtggtgcatggttgtcgtcagctcgtgtcgtgagatgttgggttaagtcccgcaacgagcgcaacccttatcctcagttgccagcgagagagacggggactctggggagactgcccgggacgaccgggaggaaggcggggatgacgtcaaatcatcatgccccttatgtcttgggctacacacgtgctacaatgggcggtacaaaccgaggcgaagccgcgaggcggagcgaaccggagaaagccgctcacagttcggattgctctctgcaactcgagagcatgaaggcggaatcgctagtaatcgcgggtcagcataccgcggtgaatacgttcccgggccttgtacacaccgcccgtcacaccacgaaagtcggcaacacccgaagtcggtgcgctaaccgcaaggaggcagccgccgaaggtggggtcgatgattggggtgaagtcgtaacaaggtagccgtatcggaaggtgcggctggatcacctcctttct

SEQ ID NO: 1001 - DNA, 1528 bp, Herbaspirillum seropedicae
agagtttgatcctggctcagattgaacgctggcggcatgccttacacatgcaagtcgaacggcagcataggagcttgctcctgatggcgagtggcgaacgggtgagtaatatatcggaacgtgccctagagtgggggataactagtcgaaagattagctaataccgcatacgatctacggatgaaagtgggggatcgcaagacctcatgctcctggagcggccgatatctgattagctagttggtggggtaaaagcctaccaaggcgacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggttttggctaatatccagaactaatgacggtacctgaagaataagcaccggctaactacgtgccagcagccgcggtaatacgtagggtgcaagcgttaatcggaattactgggcgtaaagcgtgcgcaggcggttgtgtaagacagatgtgaaatccccgggctcaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagatttgggagtgctcgaaagagaaccggcgcacaggtgctgcatggctgtcgtcagctcgtgtcgtgagatgttgggttaagtccccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgaggggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgtaaggagggcgctcaccacggtaggattcgtgactggggtgaagtcgtaacaaggtagccgtatcggaaggtgcggctggatcacctccttt

SEQ ID NO: 1002 - DNA, 1489 bp, Herbaspirillum sp. JC206
agagtttgatcctggctcagattgaacgctggcggcatgccttacacatgcaagtcgaacggcagcgcgggcttcggcctggcggcgagtggcgaacgggtgagtaatatatcggaacgtgccctagagtgggggataactagtcgaaagattagctaataccgcatacgatctacggatgaaagtgggggaccgcaaggcctcacgctcctggagcggccgatatctgattagctagttggtggggtaaaggcctaccaaggcgacgatcagtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtctgggaagaaatcccttgggctaatacctcgaggggatgacggtaccggaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaactgcatttgtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggtcggaatcctccagagatgggggagtgcccgaaagggaaccgacgcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgcagtctgcaactcgactgcatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgcttaccacggtaggattcgtgactggggtgaagtcgtaacaaggta

SEQ ID NO: 1003 - DNA, 1361 bp, Histophilus somni
ctttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgaggtgtgaaatccccgggcttaacctgggaacagcatttcagactgggtgactagagtactttagggaggggtagaattccacgtgtagcggtgaaatgcgtagagatgtggaggaataccgaaggcgaaggcagccccttgggaagatactgacgctcgagtgcgaaagcgtggggagcaaacaggattagataccctggtagtccacgctgtaaacgatgtcgatttggggattgggtgaatacttggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagccgccagagatggtggtgtgcctacgggagcttagagacaggtgctgcatggctgtcgtcagctcgtgttgtgaaatgttgggttaagtcccgcaacgagcgcaacccttatcctttgttgccagcatgttagggtgggaactcaaaggagactgccggtgataaactggaggaaggtggggatgacgtcaagtcatcatggcccttacgagtagggctacacacgtgctacaatggcgtatacagagggaggcgagcctgcgagggtaagcgaagctcagaaagtacgtctaagtccggattggagtctggaactcgactccatgaagtcggaatcgctagtaatcgcggatcagaatgtcgcggtgaatacgttcccgggccttgtacacaccgcccgtcacaccatgggagtgggttgtaccagaagtagatagcttaa

SEQ ID NO: 1004 - DNA, 1332 bp, Holdemania filiformis
gcgaacgggtgagtaatacataagcaatctgcccatcggcctgggataacagttggaaacgactgctaataccggataggtgatgaagaggcatctctcgatcattaaagttgggatacaacacggatggatgagcttatggcgtattagctagtaggtgaggtaacggctcacctaggcgatgatacgtagccgacctgagagggtgaccggccacattgggactgagacacggcccaaactcctacgggaggcagcagtagggaattttcggcaatgggcgaaagcctgaccgagcaacgccgcgtgagtgaagaaggccttcgggttgtaaagctctgttgtgaaggaagaacggctcatacagggaatggtatgggagtgacggtactttaccagaaacccggctaactacgtgccacagccgcggtaatacgtaggtggcgagcgttatccggaattattgggcgtaaagggtgcgcaggcggtttgttaagtttaaggtgaaagcgtggggcttaaccccatatagtaaaactgacagactaagtacaggagagggcaatggaattccatgtgtagcggtaaaatgcgtagatatatggaggaacaccagtggcgaaggcggttgcctggcctgtaactgacgctcatgcacgaaagcgtggggagcaatagattaataccctatagtccacgccgtaaacgatgagaactaagtgttggggaaactcatgctgcagttaacgcaataagttctccgcctggggagtatgcacgcaagtgtgaaactcagaggaattgacgggggcccgcacaagcggtggagtatgtggtttaattcgacgcaacgcgaagaaccttaccaggtcttgacatcccctgcaaagacatagagatatgttggaggttatcagggagacaggtggtgcatggttgtcgtcagctcgtgtcgtgagatgttgggttaagtcccgcaacgagcgcaacccttgtctttagttgctaacattaagttgaggactctagagagactgccggtgacaaaccggaggaaggtggggatgacgtcaaatcatcatgccccttatgacctgggctacacacgtactacaatggcggatacaacgagaagcaagacagtgatgtggagcaaaactcagaaagtccgtctcagttcggattgaagtctgcaacccgacttcatgaagccggaatcgctagtaatcgcggatcagcatgccgcggtgaatacgttctcgggccttgtacacaccgcccgtcaaaccatgagagttggcaatacccgaagccggtggcctaacctcgcaa

SEQ ID NO: 1005 - DNA, 1510 bp, Hydrogenoanaerobacterium saccharovorans
gagtttgatcatggctcaggacgaacgctggcggcgcgcctaacacatgcaagtcgaacggaactgttcggatgaagttttcggatggatgaagaacagtttagtggcggacgggtgagtaacacgtgagcaacctgcctttcagaggggaataacattcggaaacgaatgctaataccgcataatgcaacgagatggcatcatcttgctgccaaagatttatcgctgaaagatgggctcgcgcccgattagctagttggtgaggtaatggcccaccaaggcaacgatcggtagccggactgagaggttgatcggccacattgggactgagacacggcccagactcctacgggaggcagcagtgggggatattgcacaatgggcgaaagcctgatgcagcgacgccgcgtgagggaagacggttttcggattgtaaacctctgtcttcagggacgataatgacggtacctgaggaggaagcaccggctaactacgtgccagcagccgcggtaatacgtagggtgcaagcgttgtccggaattactgggtgtaaagggagcgtaggcgggattgtaagttggatgtgtaatgtaccggctcaaccggtaacttgcattcaaaactgcagttcttgagtgaagtagaggcaggcggaattcctagtgtagcggtgaaatgcgtagatattaggaggaacaccagtggcgaaggcggcctgctgggcttttactgacgctgaggctcgaaagcatgggtagcaaacaggattagataccctggtagtccatgccgtaaacgatgattactaggtgtgggtgtgcaagcatccgtgccgcagctaacgcaataagtaatccacctggggagtacggccgcaaggctgaaactcaaaggaattgacgggggcccgcacaagcagtggattatgtggtttaattcgaagcaacgcgaagaaccttaccaggtcttgacatcccttgcataccatagagatatgggaagcccttcggggcaaggagacaggtggtgcatggttgtcgtcagctcgtgtcgtgagatgttgggttaagtcccgcaacgagcgcaacccttactattagttgctacgcaagagcactctaataggactgccgttgacaaaacggaggaaggtggggatgacgtcaaatcatcatgccccttatgacctgggctacacacgtaatacaatgacgataaacagagggtagcgaagccgcgaggtggagccaatccccaaaagtcgtctcagttcggattgcaggctgcaactcgcctgcatgaagtcggaattgctagtaatcgcaggtcagcatactgcggtgaatacgttcccgggccttgtacacaccgcccgtcacaccatgggagtcggtaacacccgaagccagtagtctaaccgcaaggaggacgctgccgaaggtgggattgatgactggggtgaagtcgtaacaaggtagccgtatcggaaggtgcggctggatcacctcct

SEQ ID NO: 1006 - DNA, 1507 bp, Hyperthermus butylicus
actccggttgatcctgccggacccgaccgctatcggggtgggactaagccatgggagtcgtgcgcccccggatgcgggggcgcggcggacggctgagtaacacgtggctaacctaccctcgggacggggataaccccgggaaactggggctaatccccgataggcgagggggcctggaacgggtccctcgccgaaagggcgcgcggagcttccccgcgcgccgcccgaggatggggctgcggcccatcaggtagttggcggggtaacggcccgccaagccgataacgggtaggggccgtgggagcgggaccccccagatgggcactgagacaagggcccaggccctacggggcgcaccaggcgcgaaacctccgcaatgcgggcaaccgtgacggggtcaccccgagtgccgccgataaggcggctgttccccgctgtaagaaggcgggggagtaagcggggggcaagtctggtgtcagccgccgcggtaataccagccccgcgagcggtcgggatgcttactgggcctaaagcgcccgtagccggcccggtaagtccccccctaaagccccgggctcaacccggggagtgggggggatactaccgggctagggggcgggagaggccgagggtactcccggggtaggggcgaaatccgataatcccgggaggaccaccagtggcgaaggcgctcggctggaacgcgcccgacggtgaggggcgaaagccgggggagcaaaccggattagatacccgggtagtcccggctgtaaacgatgcgggctaggtgttgggcgggcttggagcccgcccagtgccgcagggaagccgttaagcccgccgcctggggagtacggccgcaaggctgaaacttaaaggaattggcgggggagcaccacaaggggtggagcctgcggcttaattggagtcaacgccgggaatcttaccgggggcgacagcaggatgacggccaggctgacgaccttgcccgacgcgctgagaggaggtgcatggccgtcgccagctcgtgccgtgaggtgtccggttaagtccggcaacgagcgagacccccacccctagttgctaccccgggggccaccccgggggcacactagggggactgccgccgtccaaggcggaggaaggagggggccacggcaggtcagcatgccccgaatcccccgggctgcacgcgggctacaatggcggggacagcgggatccgaccccgaaagggggaggcaatcccttaaaccccgccgcagttgggatcgagggctgcaactcgccctcgtgaacgcggaatccctagtaaccgcgcgttagcatcgcgcggtgaatacgtccctgctccttgcacacaccgcccgtcgctccacccgagcgggggaggggtgaggccctgcccctgggggcaaccccgggggtggggtcgaacccctcccccgcgaggggggagaagtcgtaacaaggtagccgtaggggaacctgcggctggatcacctcct

SEQ ID NO: 1007 - DNA, 1333 bp, Hyphomicrobium sulfonivorans
gagtttgatcctggctcagaacgaacgatggcggcaggcctaacacatgcaagtcgaacgagtggcagacgggtgagtaacgcgcgggaaccttcccaatggtgcggaatagcccagggaaacttggagtaataccgcataaggaaagtcgccattggatgggcccgcgtcgattagctagttggtagggtaacggcctaccaaggcgacgatccgtagctggtttgagagaatgaccagccacactgggactgagacacggcccagactcctacgggaggcagcagtggggaatcttggacaatgggcgcaagcctgatccagccatgccgcgtgagtgacgaaggccttagggttgtaaagctcttttgccggggacgatgacggtacccggagaataagtcccggctaacttcgtgccagcagccgcggtaatacgaaggggactagcgttgttcggaattactgggcgtaaagcgcacgtaggcggattattaagtcaggggtgaaatcccggggctcaacctcggaactgcctttgatactggtaatctagagtccgatagaggtgggtggaattcctagtgtagaggtgaaattcgtagatattaggaagaacaccagtggcgaaggcggcccactggatcgactgacgctgaggtgcgaaagcgtggggagcaaacaggattagataccctggtagtccacgccgtaaacgatggatgctagccgtcggcatgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacatgcacaggtgctgcatggctgtcgtcagctcgtgtcgtgagatgttgggttaagtcccgcaacgagcgcaaccctcgccattagttgccatcatgggcactctagtgggactgccggtgataagccggaggaaggtggggatgacgtcaagtcatcatggcccttacgggctgggctacacacgtgctacaatggcggtcagtgggcagcaacacagcgatgtgaagctaatctcagccgtctcagttcggatggtctctgcaactcgagaccagaagttggaatcgctagtaatcgcggatcagcatgccgcggtgaatacgttcccgggccttgtacacaccgcccgtcacaccatgggagttggttctacccgaaggcgatcgctaggcagtcgaccacggtagggtcagcgactggggtgaagtcgtaacaaggtaaccgta

SEQ ID NO: 1008 - DNA, 1448 bp, Hyphomonas neptunium
agagtttgattctggctcagaacgaacgctggcggcaggcctaacacatgcaagtcgaacgatatagtggcagacgggtgagtaacgcgtgggaacgtacctttcactacggaatagctctgggaaactggtggtaataccgtatacgcccttagggggaaagatttatcggtgaaagatcggcccgcgttggattagctagttggtgaggtaatggctcacaaaggcgacgatccatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgtcagggatgataatgaccgtacctgaagaagaagccccggctaacttcgtgccagcagccgcggtaatacgaagggggctagcgttgttcggaattactgggcgtaaagcgcacgtaggcggacttttaagtcaggtgtgaaatcccgaggctcaacctcggaactgcatttgaaactggaagtctggagatcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgagagctagttgttggcaggcatgcctgtcggtgacgcagttaacacattaagctctccgcctggggagtacggccgcaaggttaaaactcaaagaaattgacgggggcccgcacaagcggtggagcatgtggtttaattcgaagcaacgcgcagaaccttacctacccttgacatgtctagtatggtttccggagacggattccttcagttcggctggctagaacacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagatcgtgcgctaacttcggaggcagcgagccacggtaggatcagtaactgggatgaagtcgtaacaaggtagccgtaggggaacctgcggctggatcacctccttt

SEQ ID NO: 1009 - DNA, 1287 bp, Ignatzschineria indica
ttaacacatgcaagtcgaacgagtggcggacgggtgagtaatgcataggaatctaccttttagtctaggataactacccgaaagggtggctaatactggatgtgtaaaggcgctaagagatgagcctatgtgggattagctagttggtgaggtaacggctcaccaaggcgacgatctctagctggtttgagaggatgatcagccacactgggactgagacacggcccagactcctacgggaggcagcagtggggaatattggacaatgggcgaaagcctgatccagcaataccgcgtgtgtgaagaaggccctagggttgtaaagcacttttgttagggagaatgatgttacctaaagaataagcaccggctaactccgtgccagcagccgcggtaatacggagggtgcaagcgttaatcggaattactgggcgtaaagggcgcgtaggtggtatcttaagttgggtgtgaaatccccgggctcaacctgggaattgcatccaaaactggggtgctagagtgtggtagagggtagcggaatttctggtgtagcggtgaaatgcgtagatatcagaaggaacatcaatggcgaaggcagctacctgggccaactgacgctgaggcgcgaaagcgtggggagcaaacaggattagataccctggtagtccacgctataaacgatgacaacttgttgatggggcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatcgacaggtgctgcatggctgtcgtcagctcgtgtcgtgagatgttcggttaagtccggcaacgagcgcaacccttgtccttatttgccagcacgtgggaactctaaggagactgccggtgataaaccggaggaaggtagggacgacgtcaagtcatcatggcccttatgaccagggctacacacgtgctacaatggtcggcaatgggttgccaaaccgcgaggtggagctaatcccacccgatcccagtccggatgtagtctgcaactcgactacagaagtcggaatcgctagtaatcgtggatcagaatgccacggtgaatacgttcccgggtcttgtacacaccgcccgtcacaccatggaagttgattgctccagaagtaggtgcttagggcgcttaccacggagtggtcgatgactggggtgaagtcgtaaca

SEQ ID NO: 1010 - DNA, 1317 bp, Ignatzschineria sp. NML 95-0260
acgctggcggtatgcttaacacatgcaagtcgaacgagtggcggacgggtgagtaatgcataggaatctaccttttagtctaggataactacccgaaagggtggctaatactggatgtgtaaaggcgctaagagatgagcctatgtgggattagctagttggtgaggtaatggctcaccaaggcgacgatctctagctggtttgagaggatgatcagccacactgggactgagacacggcccagactcctacgggaggcagcagtggggaatattggacaatgggcgcaagcctgatccagcaataccgcgtgtgtgaagaaggccctagggttgtaaagcacttttgttagggagaatgatgttacctaaagaataagcaccggctaactccgtgccagcagccgcggtaatacggagggtgcaagcgttaatcggaattactgggcgtaaagggcgcgtaggtggtactttaagttgggtgtgaaatccccgggctcaacctgggaattgcatccaaaactggggtgctagagtgtggtagagggtagcggaatttctggtgtagcggtgaaatgcgtagatatcagaaggaacatcaatggcgaaggcagctacctgggccaactgacgctgaggcgcgaaagcgtggggagcaaacaggattagataccctggtagtccacgctgtaaacgatgacaacttgttgatggggcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatcgacaggtgctgcatggctgtcgtcagctcgtgtcgtgagatgttcggttaagtccggcaacgagcgcaacccttgtccttatttgccagcacgtgggaactctaaggagactgccggtgataaaccggaggaaggtagggacgacgtcaagtcatcatggcccttatgaccagggctacacacgtgctacaatggtcggcaatgggttgccaagccgcgaggtggagctaatctcatccgatcccagtccggatgtagtctgcaactcgactacagaagtcggaatcgctagtaatcgtggatcagaatgccacggtgaatacgttcccgggtcttgtacacaccgcccgtcacaccatggaagttgattgctccagaagtaggtgcttagggcgcttaccacggagtggtcgatgactggggtgaagtcgtaacaaggtagccgtagggg

SEQ ID NO: 1011 - DNA, 1469 bp, Ignicoccus islandicus
  modified_base (1377)..(1380): a, c, t, g, unknown or other
cggacccgaccgctatcggggtaaggctaagccatgggagtcgaacgcccgccgccgcgggcgtggcggacggctgagtaacacgtggctaacctaccctcgggagggggataacaccgggaaactggtgctaatcccccataggggcggtggcctggaagggtaccgccccgaaagggggaggcgggggttatcgccgcctctccgcccgaggatgcggctgcgccctatcaggtagttggcggggtaacggcccgccaagcctaagacgggtaggggccgtgggagcgggagcccccagatgggcactgagacaagggcccaggccctacggggcgcaccaggcgcgaaaactcgccaatgcgggcaaccgtgacggggttaccccgagtgcccccattacgggggcttttccccgctgtaaacaggcgggggtaataagcggggggcaagtctggtgtcagccgccgcggtaataccagccccgcgagtggtcgggacgtttattgggcctaaagcgcccgtagccggcctggtaggtcccctcctaaaacccggggctcaaccccgggggtggaggggaaaccaccaggctagggggcgggagaggccgagggtactcccggggtaggggcgaaatccgataatcccgggaggaccgccagtggcgaaggcgctcggctggaacgcgcccgacggtgaggggcgaaagccgggggagcgaaccggattagataccgggtagtcccggctgtaaacgatgcgggctaggtgttgggtgggcttcgagcccgcccagtgccgcagggaagccgttaagcccgccgcctggggagtacggccgcaaggctgaaacttaaaggaattggcgggggagcaccacaaggggtggcaggtgcggcttaattggagtcaacgccgggaacctcaccgggggcgacagcaggatgaaggtcaggctgaagaccttacctgacgcgctgagaggaggtgcatggccgtcgccagctcgtgccgtgaggtgtccggttaagtccggcaacgagcgagacccccacccctacttgctacccggggctccggccccggggcacagtagggggactgccgccgtataaggcggaggaaggagggggctatggcaggtcagcatgccccgaaacccccgggctgcacgcgggctacaatggcggggacagcgggttgcgaccccgaaagggggagcaaatccctcaaaccccgccgaggttgggatcgagggctgcaactcgccctcgtgaacgcggaatccctagtaaccgcacgttagcatcgtgcggtgaacacgtccctgctccttgcacacaccgcccgtcgctccacccgaggggacgggtnnnnaggcccccgtagggaaactcccgggtatcctcgaactccctcctctcgaggggggagaagtcgtaacaaggtagccgtaggggaacctg

SEQ ID NO: 1012 - DNA, 1414 bp, Inquilinus limosus
ttgaatcctggctcagaacgaacgctggcggcaggcctaacacatgcaagtcgaacgccccgcaaggggagtggcgcacgggtgagtaacacgtgggaacctaccttctggtacggaacaaccaagggaaactttggctaataccgtatacgacctccgggtgaaagatttatctgccggaagaggggccccgcgtccgattaggtagttggtggggtaaccggcctaccaagccgacgatcggtagctggtctgagaggatgaccagccacactgggactgagacacggcccagactcctacgggaggcagcagtggggaatattggacaatgggcgcaagcctgatccagccatgccgcgtgagtgatgaaggccttcgggttgtaaagctctttcacccacgacgatgatgacggtagtgggagaagaagccccggctaacttcgtgccagcagccgcggtaatacgaagggggcaagcgttgttcggaatgactgggcgtaaagggcgcgtaggcggttcgttgcgtcagatgtgaaagccccgggctcaacctgggaactgcatttgatacgggcgggcttgaatccaagagagggtggtggaattcccagtgtagaggtgaaattcgtagatattgggaagaacaccagtggcgaaggcggccacctggcttggcattgacgctgaggcgcgaaagcgtggggagcaaacaggattagataccctggtagtccacgccgtaaacgatgtgtgctagccgtcgggcagcttgctgttcggtggcgcagctaacgcgataagcacaccgcctggggagtacggtcgcaagattaaaactcaaaggaattgacgggggcccgcacaagcggtggagcatgtggtttaattcgaagcaacgcgcagaaccttaccaacccttgacatggggagtgtgggcctgagagatcgggtccgggtccttcagttcggctggctcccacacaggtgctgcatggctgtcgtcagctcgtgtcgtgagatgttgggttaagtcccgcaacgagcgcaaccctcctcttcagttgccatcattgagttgggcactctggagatactgccggtgacaagccggaggaaggcggggatgacgtcaagtcctcatggcccttacgggttgggctacacacgtgctacaatggcggtgacagtgggcagcgaaggggcgacctggagctaatccccaaaagccgtctcagttcggattgcactctgcaactcgggtgcatgaagttggaatcgctagtaatcgcggatcagcacgccgcggtgaatacgttcccgggccttgtacacaccgcccgtcacaccatgggagttggttttacccgaagacggtgcgctgacccgcaagggaggcagccggccacggt

SEQ ID NO: 1013 - DNA, 1473 bp, Janibacter limosus
gacgaacgctggcggcgtgcttaacacatgcaagtcgaacggtgaagctccagcttgctggagtggatcagtggcgaacgggtgagtaacacgtgagcaacctgccccagactctggaataagcgctggaaacggcgtctaatactggatacgagaccaacctgcatgggtatggtctggaaagtttttcggtttgggatgggctcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggaactaggtgtgggtctcattccacgagatccgtgccgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacttccagagatggttgccccttttaggtcggtatacaggtggtgcatggttgtcgtcagctcgtgtcgtgagatgttgggttaagtcccgcaacgagcgcaaccctcgttctatgttgccagcacgtaatggtggggactcatggaagactgccggggtcaactcggaggaaggtggggatgacgtcaaatcatcatgccccttatgtcttgggcttcacgcatgctacaatggccggtacaaagggctgcgaaaccgcaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtcgtaacaaggtagccgtaccggaa

SEQ ID NO: 1014 - DNA, 1389 bp, Janibacter melonis
cgaacggtgaactttggagcttgctctaaggggatcagtggcgaacgggtgagtaacacgtgagtaacctgccccggactctggaataagcgctggaaacggcgtctaataccggatacgagacgcaaccgcatggttagtgtctggaaagtttttcggtctgggatggactcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacatccagagatgggtgccccttttggtcggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggctgcgataccgcaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaa

SEQ ID NO: 1015 - DNA, 1496 bp, Janthinobacterium sp. SY12
tagagtttgatcatggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctacggatgaaagtgggggatcgcaagacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagggctaatatcccttgctaatgacggtacctgaagaataagcaccggctaactacgtgccagcagccgcggtaatacgtagggtgcaagcgttaatcggaattactgggcgtaaagcgtgcgcaggcggctttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccctgagagattggggagtgctcgaaagagaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttacgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgta

SEQ ID NO: 1016 - DNA, 1478 bp, Johnsonella ignava
  modified_base (37)..(37): a, c, t, g, unknown or other
  modified_base (86)..(86): a, c, t, g, unknown or other
  modified_base (408)..(408): a, c, t, g, unknown or other
  modified_base (452)..(452): a, c, t, g, unknown or other
  modified_base (477)..(477): a, c, t, g, unknown or other
  modified_base (480)..(480): a, c, t, g, unknown or other
  modified_base (1338)..(1338): a, c, t, g, unknown or other
tgaacgctggcggcgtgcttaacacatgcaagtcgancggagactttttcagtgcaaccttcggggagcaagagaagtcttagtgncggacgggtgagtaacgcgtgggcaacctgcctcgcaccgtgggataacagggggaagctcctgctaataccgcataaagtatatagacgcatgtcaatatacaaaaagggataccggtgagagatgggcccgcgtccgattagatagttggcaggatagcagcctaccaagtcaacgatcggtagccggcttgagagagtggacggccacactgggactgagacacggcccagactcctacgggaggcagcagtggggaatattggacaatgggggcaaccctgatccagcgacgccgcgtgagtgaagaagtatctcggnacgtaaagctctatcagcagggaagaaaaaagacggtacctgantaagaagccccggctaactacgtgncancagccgcggtaatacgtagggggcaagcgttatccggaattactgggtgtaaagggagcgtagacggctatgcaagtctggagtgaaatgccggggctcaaccccggagctgctctggaaactgcgtggcttgagtgtcggaggggcaggcggaattcccagtgtagcggtgaaatgcgtagatattgggaggaacaccggcggcgaaggcggcctgctggacgacaactgacgttgaggctcgaaggcgtgggtagcaaacaggattagataccctggtagtccacgcagtaaacgatgaatactaggtgtcggggagttaaatttccggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagccttgacatgccggtgaagggggagtaaaatcctctgccccttggggcaccggacacaggtggtgcatggttgtcgtcagctcgtgtcgtgagatgttgggttaagtcccgcaacgagcgcaaccctcattcccggtagccagcagtaagatggggactccggggagactgccgaggaagactcggaggaaggcggggatgacgtcaaatcatcatgccccttatggtttgggctacacacgtgctacaatggcgcagacagagggaagcaaggccgcgaggcagagcaaatctcaaaaactgcgtctcagttcggattgcaggctgcaactcgcctgcatgaagccggaatcgctagtaatcgcagatcagaatgctgcggtgaatacgtncccgggtcttgtacacaccgcccgtcacaccatgggagtcggcaatgcccgaagtcagtggcccaaccgtaaggagggagctgccgaaggcagggcggatgaccggggtgaagtcgtaacaaggtagccgtatcggaagg

SEQ ID NO: 1017 - DNA, 1523 bp, Jonquetella anthropi
gagagtttgatcctggctcaggataaacgctggcggcgtgcttaacacatgcaagttggacgggaatactcgaggaagagacttcggttaattttttgggtatgagagtagcggacgggtgagtaatgcataagaatctatccatcagagggggacaactgcgggaaaccggagctaataccccgtaagccggaaggtgaaagggagcaatccgctgatggaggagcttgtgtcctatcaggtagttggtgaggtaagagctcaccaagccgaagacgggtagccgggctgagaggttgtacggccacattggaactgagagacggtccagactcctacgggaggcagcagtggggaatattgggcaatgggcgaaagcctgacccagcgacgccgcgtgagggaagacggccttcgggttgtaaacctctgttgcaggggaagaaggaagtgacggtaccctgcgaggaagctccggcaaactacgtgccagcagccgcggtaatacgtagggagcgagcgttatccggaattactgggcgtaaagggcgcgtaggcggaatgacaagtcagcaagtgaaagcgtggggctcaaccccatgatgcggctgaaactgttattctagaggcatggagaggcaaacggaattcccggtgtagcggtgaaatgcgtagatatcgggaagaacaccagtggcgaaggcggtttgctggccatgaactgacgctcatagcgcgaaagctagggtagcaaacgggattagataccccggtagtcctagcagtaaacgatgtatgctgggtgtgggtgtagcgatacatccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctgggcttgacatgtaaggaaaggtgtatggagacgtacaagtgtactgcttcggtagtacgccttacacaggtgctgcatggctgtcgtcagctcgtgtcgtgagatgttgggttaagtcccgcaacgagcgcaacccctattgccagttgctaacaggtagagctgagcactcaggcgagactgccgccgacaaggtggaggaaggtggggatgacgtcaagtcatcatggcccttatgcccagggccacacacatgctacaatggccggtacaaagggaagcgaggctgcgaagcggagcgaaccccaaaagccggtcccagttcggattgcagtctgcaactcgactgcatgaagttggaatcgctagtaatcgcgaatcagcgaagtcgcggtgaatacgttcccgggccttgtacacaccgcccgtcacaccatccgagttggatgcactccaagtcggtatctcaaccgcaaggggggagccgcccaaagtgtgtctggtgaggagggtgaagtcgtaacaaggtagccgtaccggaaggtgcggctggatcacctcctt

SEQ ID NO: 1018 - DNA, 1414 bp, Kerstersia gyiorum
gcgggatgctttacacatgcaagtcgaacggcagcacgaggagcttgctccttggtggcgagtggcgaacgggtgagtaatatatcggaacatgcccagtagcgggggataactactcgaaagagtggctaataccgcatacgtcctacgggagaaagcaggggaccttcgggccttgcactattggagtggccgagatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcaggaaagaaatcgcccgggataatacctcgggtggatgacggtacctgaagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagaggggggtggaattccgcgtgtagcagtgaaatgcgtagatatgcggaggaacaccgatggcgaaggcagccccctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaaaccgcgaggtggagctaatctcagaaacccgatcgtagtccggattgtagtctgcaactcgactacatgaagtcggaatcgctagtaatcgcggatcagaatgtcgcggtgaatacgttcccgggtcttgtacacaccgcccgtcacaccatgggagtgggttctaccagaagtagttagcctaaccgcaaggaggg

SEQ ID NO: 1019 - DNA, 1541 bp, Kingella denitrificans
ttgaacataagagtttgatcctggctcagattgaacgctggcggcatgctttacacatgcaagtcggacggcagcgggggtgcttgcacctgccggcgagtggcgaacgggtgagtaacatattggaatgtaccgagtagtgggggataaccaatcgaaagattggctaataccgcatacgtcctgagggggaaagcaggggatcttcggaccttgcgctatttgagcagccaatatctgattagctagttggtggggtaaaggcccaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgttagggaagaaaagggaagtgttaataccactttttgttgacggtacctaaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcgattagctgttgggcaacttgattgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaagaactcagagacgagtttgtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttct

SEQ ID NO: 1020 - DNA, 1288 bp, Kingella genomosp. P1 oral cone MB2_C20
cgctggcggcatgctttacacatgcaagtcgaacgagtggcgaacgggtgagtaagatattggaacgtaccgagtaatgggggataactatccgaaaggatagctaataccgcatacggaaagacgttattcgagcggccaataactgattagctagttggaggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggtttattaagcaagatgtgaaatccccgagcttaacttgggaactgcgttttgaactggtaggctagagtatgtcagaggggggtagaattccacgtgtagcagtgaaatgcgtagatatcaagaagaatacctattgcgaaggcgatctgctggaactactgacgctaatgcgtgaaagcgtggggagcaaacaggattagataccctggtagtccacgccctaaacgatgtataccggttgttgctgcggcagtaatccacctaacggattaagtataccgcctggggagtacggtcgcaagattaaaactcaaaggaatagacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccaccatgggcactctaatgagactgccggtgacaaaccggaggaaggtggggatgacgtcaagtcctcatggcccttatgaccagggcttcacacgtcatacaatggtcggcagagggtagccaaaccgcgaggtggagccaatctcagccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatgtttcatgactggggtg

SEQ ID NO: 1021 - DNA, 1541 bp, Kingella kingae
ttgaacataagagtttgatcctggctcagattgaacgctggcggcatgctttacacatgcaagtcggacggcagcacgagtacttgtacttggtggcgagtggcgaacgggtgagtaatatattggaacgtaccgagtaatgggggataactatccgaaaggatagctaataccgcatacgctttgagaaggaaagcaggggatcttcggaccttgcgttattcgagcggccaataactgattagctagttggtggggtaagggcccaccaaggcgacgatcagtagtgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgttagggaagaaaaggttgatgctaatatcattaactgatgacggtacctaaagaataagcaccggctaactacgtgccagcagccgcggtaatacgtagggtgcgagcgttaatcggaattactgggcgtaaagcgagcgcagacggttagttaagcaagatgtgaaatccccgagctcaacttgggaactgcgttttgaactggctagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaagagagtagagatactcttgtgccttcgggagccgtagcacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtagatagggtaaccgcaaggagcccgtttaccacggtatgtttcatgactggggtgaagtcgtaacaaggtagccgtaggggaacctgcggctggatcacctcctttct

SEQ ID NO: 1022 - DNA, 1547 bp, Kingella oralis
aacataagagtttgatcctggctcagattgaacgctggcggcatgctttacacatgcaagtcgaacggcagcacgaaagagcttgctcttttggtggcgagtggcgaacgggtgagtaatgcatcggaacgtaccgagtaatgggggataactatccgaaaggatagctaataccgcatacgctttgagaaggaaagtgggggctcttcggacctcacgttattcgagcggccgatgtctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaaaggatagtgttaataccattatctgctgacggtacctaaagaataagcaccggctaactacgtgccagcagccgcggtaatacgtagggtgcgagcgttaatcggaattactgggcgtaaagcgagcgcagacggtttattaagcaagatgtgaaatccccgagcttaacttgggaactgcgttttgaactggtaagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcaattagctgttgggcaacatgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcttccagagacggaagagtgccttcgggagccgtaacacaggtgctgcatggctgtcgtcagctcgtgtcgtgagatgttgggttaagtcccgcaacgagcgcaacccttgtcattagttgccaccattcagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatctcagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggctaaccgcaaggaggccgcttaccacggtatgtttcatgactggggtgaagtcgtaacaaggtagccgtaggggaacctgcggctggatcacctcctttctagaga

SEQ ID NO: 1023 - DNA, 1360 bp, Kingella sp. oral clone ID059
gagtttgatcctggctcagattgaacgctggcggcatgctttacacatgcaagtcggacgagtggcgaacgggtgagtaatatattggaacgtaccgagtagtgggggataactaagcgaaagtttggctaataccgcatacggaaaggcgctatttgagcggccaatatctgattagctagttggtggggtaagggcttaccaaggcgatgatcagtagcgggtctgagaggatgatccgccacactgggactgagagacggcccagactcctacgggaggcagcagtggggaattttggacaatgggggcaaccctgatccagccatgccgcgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggttatttaagtcagatgtgaaatccccgagcttaacttgggaactgcgtttgaaactgggtaactagagtatgtcagaggggggtagaattccacgtgtagcagtgaaatgcgtagagatgtggaggaataccgatggcgaaggcagccccctgggataactgacgttcatgctcgaaagcgtgggtagcaaacaggattagataccctggtagtccacgccctaaacgatgtcaattagctgttggtgcattagtagcgaagctaacgcgtgaaattgaccgcctggggagtacggtcgcaagattaaaactcaaaggaattgacggggacccgcacaagcgatggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtagccaagccgcgaggtggagccaatcccaaccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtgaatagttcgcttaccacggtatgtttcatgactggggtgaagtcgtaacaaggtagccgtaggggaacctgcggctggaacacctc

SEQ ID NO: 1024 - DNA, 1021 bp, Klebsiella oxytoca
  modified_base (741)..(742): a, c, t, g, unknown or other
  modified_base (969)..(969): a, c, t, g, unknown or other
  modified_base (974)..(975): a, c, t, g, unknown or other
  modified_base (985)..(985): a, c, t, g, unknown or other
  modified_base (1001)..(1001): a, c, t, g, unknown or other
gcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtnncgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctganacagnngctgcatggntgtcgtcagctcgtgntgtgaaatgttgggttaagt

SEQ ID NO: 1025 - DNA, 1399 bp, Klebsiella pneumoniae
tcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttaggcggtctgtctagtcgcatgtggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 1026 - DNA, 1277 bp, Klebsiella sp. AS10
cagattgaacgctggcggcaggcctaacacatgcaagtcgaacgagtggcggacgggtgagtaatgtctgggaaactgcctgatggagggggataactactggaaacggtagctaataccgcataaccaaagttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgctgtaaacgatgtcgacttggaggttgttagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcatacaaagagaagcgacctcgcgagagcaagcggacctcattatgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccac

SEQ ID NO: 1027 - DNA, 1398 bp, Klebsiella sp. Co9935
tcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgtaggtgaggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtgaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcg

SEQ ID NO: 1028 - DNA, 1282 bp, Klebsiella sp. OBRC7
tggctcagattgaacgctggcggcaggcctaacacatgcaagtcgaacgagtggcggacgggtgagtaatgtctgggaaactgcctgatggagggggataactactggaaacggtagctaataccgcataaccaaagttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggatgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgctgtaaacgatgtcgacttggaggttgttagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgagtagggctacacacgtgctacaatggcatacaaagagaagcgacctcgcgagagcaagcggacctcattatgtcgtagtccggatggagtctgcaactcgactccagaagtcggaatcgctagtaatcgtggatcagaatgccacggtgaatacgttcccgggccttgtacacaccgcccgtcacaccatgggagtgggttgcaaaagaagtaggtgcttagggcgcttaccac

SEQ ID NO: 1029 - DNA, 1237 bp, Klebsiella sp. SP-BA
  modified_base (358)..(358): a, c, t, g, unknown or other
  modified_base (369)..(370): a, c, t, g, unknown or other
aagtcgagcgagcggcggacgggtgagtaatgtctgggaaactgcctgatggagggggataactactggaaacggtagctaataccgcataatcaaagatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggatgacgttacccgcagaagaagcaccngctaactccgnnccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaactgacgctcaggtgcgaaagcgtggggagcaaacaggattagataccctggtagtccacgccgtaaacgatgtcgatttggaggttgtgcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatcgacaggtgctgcatggctgtcgtcagctcgtgttgtgaaatgttgggttaagtcccgcaacgagcgcaacccttatcctttgttgccagcggccgggaactcaaaggagactgccagtgataaactggaggaaggtggggatgacgtcaagtcatcatggcccttacgaccagggctacacacgtgctacaatggcatacaaagagaagcgacctcgcgagagcaagcggacctcattatgtcgtagtccggatggagtctgcaactcgactccagaagtcggaatcgctagtaatcgtagatcagaatgctacggtgaatacgttcccgggccttgtacacaccgcccgtcacaccatgggagtgggttgcaaaagaagtaggtgcttagggcgct

SEQ ID NO: 1030 - DNA, 1509 bp, Klebsiella sp. SRC_DSD11
ccgcagagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtag

SEQ ID NO: 1031 - DNA, 1006 bp, Klebsiella sp. SRC_DSD12
  modified_base (952)..(952): a, c, t, g, unknown or other
  modified_base (957)..(957): a, c, t, g, unknown or other
  modified_base (962)..(962): a, c, t, g, unknown or other
  modified_base (971)..(973): a, c, t, g, unknown or other
  modified_base (984)..(985): a, c, t, g, unknown or other
  modified_base (995)..(995): a, c, t, g, unknown or other
tcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccaganatggnttggngccttcggnnntgtgagacagnngctgcatggntgtcgtcagct

SEQ ID NO: 1032 - DNA, 1504 bp, Klebsiella sp. SRC_DSD15
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgta

SEQ ID NO: 1033 - DNA, 1506 bp, Klebsiella sp. SRC_DSD1
agagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctgggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtag

SEQ ID NO: 1034 - DNA, 1506 bp, Klebsiella sp. SRC_DSD2
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagccggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgtcaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtagc

SEQ ID NO: 1035 - DNA, 1497 bp, Klebsiella sp. SRC_DSD6
agagtttgatcctggctcagattgaacgctggcggcaggcctaacacatgcaagtcgagcggtagcacagagagcttgctctcgggtgacgagcggcggacgggtgagtaatgtctgggaaactgcctgatggagggggataactacggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagagggggtagaattccaggtgtagcggtgaaatgcgtagagatctgggggaataccggtggcgaagcggccccctggacaaagactgacgctcagtgcgaaagcgtggggagcaaacaggattagataccctggtagtcccgccgtaaacatgtcgatttggaggttgtgcccttgaggcgtggcttccggagctaacgcgttaaatcgacccctggggagtacggccgcaaggttaaaactcaaatgaattgacgggggcccgcacaagcggtggagcatgtggttaattcgatgcaacgcgaagaaccttacctggtcttgacatccacagaactttccagagatggattggtgcctcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaattgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaaatcgtaacaaggtagccgtagc

SEQ ID NO: 1036 - DNA, 1420 bp, Klebsiella sp. enrichment culture clone SRC_DSD25
tcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctgggggaataccggtggcgaaagcggccccctggacaaagactgacgctcagtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaattgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaaatcgtaacaaggtagccg

SEQ ID NO: 1037 - DNA, 934 bp, Klebsiella variicola
  modified_base (705)..(706): a, c, t, g, unknown or other
cggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctggtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtnngagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacag

SEQ ID NO: 1038 - DNA, 1387 bp, Kluyvera ascorbata
  modified_base (964)..(965): a, c, t, g, unknown or other
gcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttaacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctatttgaaggttgttcccttgaggagtggctttcggagctaacgcgttaaatagaccgcctggggagtacggccgcaaggttaaaactcaaatgaattgacgggggcccgcacaagcggtggagcatgtggtttaattcgatgcaacgcgaagaaccttacctactcttgacatccagagaaattgggagagatgctttcgcgccttcggggtnnatgagacagtggctgcatgggtgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 1039 - DNA, 1395 bp, Kluyvera cryocrescens
tcgaacggtagcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagacatgctttggtgccttcgggaactctgagacagcaggcggtcggtcaagtcggatgtgaattcccaaggctcggcttaggacccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagg

SEQ ID NO: 1040 - DNA, 1482 bp, Kocuria marina
agagtttgatcatggctcaggaccaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatatgacctcctgtcgcatggtggggggtggaaagggtttgtactggttgtggatgggctcacggcctatcagcttgttggtggggtaatggcctaccaaggcgacgacgggtatccggcccgagagggtgaccggccaccctgggactgagacacggcccagactcctacgggaggcagcagtggggaatattgcacaatgggcgcaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtaaggcgcaagcgttgtccggaattattgggcgtacagagctcgtaggcggtttgtcgcgtctgctgtgaaagcccggggcttaaccccgggtgtgcagtgggtacgggcagacttgagtgcagtaggggagactggaactcctggtgtagcggtgaaatgcgcacatatcaggaagaacaccgatggcgaaggcaggtctctgggctgttactgacgctgacgagctaaagcatggggagcgaactggattggataccctggtagtccatgccgtaaacattgggcactaggtgtgggggacattccacgttttccgcgccgtagctaacgcattaagtgccccgcctggggagtacggccgcaaggctaaaactcaaaggaattgacaggcgcccgtacaaggggcggggcatggggattatttggatgcaactcgaagaacttttccagggcttgacatacaccggatcggctcagagatgagtttccctccttttggggctggtgtacaggtggtgcatggttgtcgtcagctggtgtcgtgagatgtggggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgataccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgta

SEQ ID NO: 1041 - DNA, 1419 bp, Kocuria palustris
ggcggcgtcttacacatgcagtcgaacgctgaagcaccagcttgctggtgtggatgagtggcgaacgggtgagtaatacgtgagtaacctgcccttgactctgggataagcccgggaaactgggtctaatactggatgctacatgtcaccgcatggtggtgtgtggaaagggtttactggtcttggatgggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagccacaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagactagagtgcagtaggggagactggaattcctggtgtagcggtggaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatataccggatcgttccagagatggttcttcccctttggggtcggtatacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagccgtcgaaggtgg

SEQ ID NO: 1042 - DNA, 1454 bp, Kocuria rhizophila
ggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatacgacatgtcaccgcatggtggtgtgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtgaggatgacgtcaaatcatcatgccccttatgtcttgggcttcacgcatgctacaatggccagtacaatgggttgcgatgccgcgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggact

SEQ ID NO: 1043 - DNA, 1481 bp, Kocuria rosea
atcctggctcaggacgaacgctggcggcgtgcttaacacatgcaagtcgaacgatgatgcccagcttgctgggcggattagtggcgaacgggtgagtaatacgtgagtaacctgcccttgactctgggataagcctgggaaactgggtctaatactggatactacctcttaccgcatggtgggtggtggaaagggttttactggttttggatgggctcacggcctatcagcttgttggtggggtaatggctcaccaagccgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtctgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacattcaccggaccgccccagagatggggtttcccttcggggctggtggacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggactggcgattgggactaagtcgtaacaaggtagccgt

SEQ ID NO: 1044 - DNA, 1333 bp, Kocuria varians
  modified_base (1040)..(1040): a, c, t, g, unknown or other
cgctgaagcttggtgcttgcactgggtggatgagtggcgaacgggtgagtaatacgtgagtaacctgcccttaactctgggataagcctgggaaactgggtctaatactggatatgacatgtcactgcatggtggcgtgtggaaagggttttactggttttggatgggctcacggcctatcagcttgttggtggggtaatggcccaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcacggaagaagcgagagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaagaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccggtccagagatggatcttcccccttgtggggctggtgtacaggtggtgcatggttgtcgtcagctcgtgtcgtaagatgttgggttaagtcccgcaacgagcgcaaccctcgttntatgttgccagcacgtgatggtggggactcataggagactgccggggtcaactcggaggaaggtggggatgacgtcaaatcatcatgccccttatgtcttgggcttcacgcatgctacaatggccggtacaatgggttgcgataccgtgaggtggagctaatcccaaaaagccggtctcagttcggatcgtggtctgcaactcgaccacgtgaagtcggagtcgctagtaatcgcagatcagcaacgctgcggtgaatacgttcccgggccttgtacacaccgcccgtcaagt

SEQ ID NO: 1045 - DNA, 1493 bp, Lachnobacterium bovis
  modified_base (85)..(85): a, c, t, g, unknown or other
gagtttgatcatggctcaggatgaacgctggcggcgtgcttaacacatgcaagtcgaacgaagcacattatttgaattcttcggnaggaagataatgcgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatgggcgaaagcctgatgcagcgacgccgcgtgaacgaagaagtatttcggtatgtaaagttctatcagcagggaagaaaaaatgacggtacctgactaagaagccccggctaactacgtgccagcagccgcggtaatacgtagggggcaagcgttatccggatttactgggtgtaaagggagcgcaggcggcccggcaagtctgatgtgaaaacccaaggctcaaccatgggattgcattggaaactgtcgagctagagtatcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggtgttatgaacattcggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaagctatgtaatgtagcctctcttcggagcattggagacaggtggtgcatggttgtcgtcagctcgtgtcgtgagatgttgggttaagtcccgcaacgagcgcaacccttgtccttagtagccagcagtaagatgggcactctagggagactgccagggataacctggaggaaggtggggatgacgtcaaatcatcatgccccttatgacttgggctacacacgtgctacaatggcgtaaacaaagtgaagcgagatggtgacattaagcaaatcacaaaaataacgtctcagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagccggtgacctaaccgtaaggaaggagccgtcgaaggcaggatcgataactggggtgaagtcgtaacaaggtaacca

SEQ ID NO: 1046 - DNA, 1518 bp, Lachnospira multipara
tttgatcctggctcaggatgaacgctggcggcgtgcttaacacatgcaagtcgaacgaagcaacwtatcacgattccttcgggatgacgatttgttgactgagtggcggacgggtgagtaacgcgtgggtaacctgccttatacagggggatagcagctggaaacggctgataataccgcataagcgcacggcatcgcatgatgcagtgtgaaaaactccggtggtataagatggacccgcgtctgattagctagttggtgaggtaacggcccaccaaggcaacgatcagtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggagtgtaggtggcaaagcaagtcagtagtgaaaatccggggctcaacctcggaactgctattgaaactgtttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgttgggtctcataagagattcggtgccgcagctaacgcaataagtattccacctggggagtacgttcgcaagaatgaaactcaaaggaattgacggggacccgcacaagcggtggagcatgtggtttaattcgaagcaacgcgaagaaccttacctagtcttgacatcccgatgaccragtatgtaatgtactctttcttcggaacatcggtgacaggtggtgcatggttgtcgtcagctcgtgtcgtgagatgttgggttaagtcccgcaacgagcgcaacccctatttctagtagccagcagttcggctgggcactctagagagactgccagggataacctggaggaaggtggggatgacgtcaaatcatcatgccccttatgactagggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctcct

SEQ ID NO: 1047 - DNA, 1383 bp, Lachnospira pectinoschiza
  modified_base (11)..(12): a, c, t, g, unknown or other
  modified_base (14)..(14): a, c, t, g, unknown or other
  modified_base (22)..(23): a, c, t, g, unknown or other
  modified_base (30)..(31): a, c, t, g, unknown or other
  modified_base (37)..(40): a, c, t, g, unknown or other
cgaagcatttnncnacggattnnttcgganntgaagnnnnttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggaccgcacaagcggtggagcatgtggtttaattcgaagcaacgcgaagaaccttaccaagtcttgacatcctcttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatataaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaagaag

SEQ ID NO: 1048 - DNA, 1519 bp, Lachnospiraceae bacterium 1_1_57FAA
agagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacct

SEQ ID NO: 1049 - DNA, 1384 bp, Lachnospiraceae bacterium 1_4_56FAA
  modified_base (33)..(33): a, c, t, g, unknown or other
  modified_base (229)..(229): a, c, t, g, unknown or other
tcgaacgaagcactttaccggatttcttcggantgaaagttttgtgactgagtggcggacgggtgagtaacgcgtgggtaacctgcctcatacagggggataacagttagaaatgactgctaataccgcataagaccacaggattgcatggtccggtggtaaaaactccggtggtatgagatggacccgcgtctgattagctagttggtggggtaacggcttaccaagncgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaagacggtacctgctaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaaccttacctgcccttgacatccggctgactggcgagtaatgtcgcctttccttcgggacagccgagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgggcagggctacacacgtgctacaatggcgtaaacaaagggaggcaagcctgcgagggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagg

SEQ ID NO: 1050 - DNA, 1528 bp, Lachnospiraceae bacterium 2_1_46FAA
gagagtttgatcctggctcaggatgaacgctggcggcgtgcttaacacatgcaagtcgaacgaagcgctttcgattgaatcttcggaggaaagaggaagtgactgagtggcggacgggtgagtaacgcgtgggtaacctgcctcatacagggggataacagttagaaatggctgctaataccgcataagcatacagcaccgcatggtgcagtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagtgcaagtctgaagtgaaagcccggggctcaaccccgtgactgctttggaaactgtgcttctagagtgtcggagaggtaagcggaattcctagtgtagcggtgaaatgcgtagatattaggaggaacatcagtggcgaaggcggcttactggacgataactgacgttgaggctcgaaagcgtggggagcaaacaggattagataccctggtagtccacgccgtaaacgatgactactaggtgtcggggtacaaagtacttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggtcttgacatctccctgactggacagtaatgtgtcctttctttcgggacagggaagacaggtggtgcatggttgtcgtcagctcgtgtcgtgagatgttgggttaagtcccgcaacgagcgcaacccctatcttcagtagccagcaagtaaagttgggcactctggagagactgccagggataacctggaggaaggtggggacgacgtcaaatcatcatgccccttatgaccagggctacacacgtgctacaatggcgtaaacaaagggaagcaagcatgtgagtgtgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgaaaggaaggagctgccgaaggtgggactgataactggggtgaagtcgtaacaaggtagccgtatcggaaggtgcggctggatcacctcctttct

SEQ ID NO: 1051 - DNA, 1361 bp, Lachnospiraceae bacterium 2_1_58FAA
cgaagcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgataagtatttcggtatgtaaagctctatcagcagggaagaaaatgacggtacctgctaagaagccgctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgatggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcatttaagatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgac

SEQ ID NO: 1052 - DNA, 1373 bp, Lachnospiraceae bacterium 3_1_57FAA_CT1
aggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggcaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgtccgtaacggggcattctcttcggagcattggagacagggggagcatggcggtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgcaagggaggagca

SEQ ID NO: 1053 - DNA, 1370 bp, Lachnospiraceae bacterium 4_1_37FAA
attcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagcttgttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctggagtgtcggagaggcaagcggaattcctagtgtagcggtgaaatgcgtagatattaggaggaacaccagtggcgaaggcggcttgctggacgataactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaacgctcattaatcgggctcttccccggggctgcttgggaaacggtgcagctggagtgtcggagctcgtgtcgtgagatgttgggttaagtcccgcaacgagcgcaacccctatcttcagtagccagcattaaggatgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctg

SEQ ID NO: 1054 - DNA, 1357 bp, Lachnospiraceae bacterium 5_1_57FAA
cgaagcgcctggccccgacttcttcggaatgaggagccttgcgactgagtggcggacgggtgagtaacgcgtgggcaacctgccttgcactgggggataacagccagaaatggctgctaataccgcataagaccgaagcgccgcatggggcagcggccaaagccccggcggtgcaagatgggcccgcgtctgattaggtagttggcggggtaacggcccaccaagccgacaatcagtagccgacctgagagggtgaccggccacattgggactgagacacggcccacactcctacgggaggcagcagtggggaatattgcacaatgggggaaaccctgatgcagcgacgccgcgtgaaggatgaagtatttcggtatgtaaacttctatcaccagggaagaaaatgacggtacctgactaagaagccccggctaactacgtgccacagccgcggtaatacgtagggggcaagcgttatccggatttactgggtgtaaagggagcgtaacggcgatgcaagccaatgtgaaagcccggggctcaaccccgggactgcatttggaactgcgtggctggagtgtcgagaggcaggcggaattctagtgtacggtgaaatgcgtaatattagaggaacaccagtggcgaagcggcctgctggacatgactgacgttgaggctcgaaagcgtggggagcacaggattaataccctggtagtccacgccgtaacgatgactactagtgtcgggtggaaggccattcgtgccgcagcaacgcaataagtagtccacctggggagtacgttcgcaagaatgaaactcaaggaattgacgggaccccacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgca

SEQ ID NO: 1055 - DNA, 1537 bp, Lachnospiraceae bacterium 5_1_63FAA
ttgaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 1056 - DNA, 1370 bp, Lachnospiraceae bacterium 6_1_63FAA
cgaagcacttatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaagctttactaggtgtaaagggagcctagacggtacatcaactgtgatgtgaaaggcgacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaa

SEQ ID NO: 1057 - DNA, 1527 bp, Lachnospiraceae bacterium 8_1_57FAA
gagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 1058 - DNA, 1387 bp, Lachnospiraceae bacterium 9_1_43BFAA
  modified_base (13)..(13): a, c, t, g, unknown or other
tcgaacgaagcancttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagcttgttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctggagtgtcggagaggcaagcggaattcctagtgtagcggtgaaatgcgtagatattaggaggaacaccagtggcgaaggcggcttgctggacgataactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctattgacatccctctgaccgctctttaatccgggggttccacccggggactggtttggaaaggggcatggtggtcgtcagctcgtgtcgtgagatgttgggttaagtcccgcaacgagcgcaacccctatcttcagtagccagcattaaggatgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagg

SEQ ID NO: 1059 - DNA, 1483 bp, Lachnospiraceae bacterium A4
agagtttgatcatggctcaggatgaacgctggcggcgtgcttaacacatgcaagtcgaacggactcatattgaaacctagtgatgtatgagttagtggcggacgggtgagtaacgcgtggagaacctgccgtatactgggggataacacttagaaataggtgctaataccgcataagcgcacagcttcgcatgaagcagtgtgaaaaactccggtggtatacgatggatccgcgtctgattagcttgttggcggggtaaaggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtacgtaaagctctatcagcagggaagaaaatgacggtacctgactaagaagccccggctaactacgtgccagcagccgcggtaatacgtagggggcaagcgttatccggatttactgggtgtaaagggagcgtagacggcagcgcaagtctggagtgaaatcccatggcttaaccatggaactgctttggaaactgtgcagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgctgtaaacgatgattactaggtgttgggggaccaaggtccttcggtgccgtcgcaaacgcattaagtaatccacctggggagtacgttcgcaagaatgaaactcaaaggaattgacggggacccgcacaagcggtggagcatgtggtttaattcgaagcaacgcgaagaaccttacctggtcttgacatcccagtgacgcatgagtaaagtcatgtttccttcgggacactggagacaggtggtgcatggttgtcgtcagctcgtgtcgtgagatgttgggttaagtcccgcaacgagcgcaacccctatttccagtagccagcatgtaaagatgggcactctggagagactgcctaggataactaggaggaaggcggggatgacgtcaaatcatcatgccccttatgatcagggctacacacgtgctacaatggcgtaaacaaagggaagcaaagcggtgacgccaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtgacctaaccgaaagggaggagctgccgaaggtggagccggtaactggggtgaagtcgtaacaaggtaacc

SEQ ID NO: 1060 - DNA, 1485 bp, Lachnospiraceae bacterium DJF VP30
  modified_base (485)..(485): a, c, t, g, unknown or other
agagtttgatcatggctcaggatgaacgctggcggcgtgcttaacacatgcaagtcgaacggagtcatcctctgtcaaagcttcggcagagacttggttaacttagtggcggacgggtgagtaacgcgtgggtaacctgccatgtacagggggataacacttagaaataggtgctaaaaccgcataagcgcacggtaccgcatggtacagtgtgaaaaactccggtggtacatgatggacccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcaggaagaaatcaatgcggtacctgactaagaagcnccggctaactacgtgccagcagccgcggtaatacgtagggggcaagcgttatccggatttactgggtgtaaagggagcgtagacggcatggcaagtctgaagtgaaaggccagggctcaaccctgggactgctttggaaactgtcaggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggagtatagacttttcggtgccgcagccaacgcaataagtattccacctggggagtacgttcgcaagaatgaaactcaaaggaattgacggggacccgcacaagcggtggagcatgtggtttaattcgaagcaacgcgaagaaccttacctggtcttgacatcccgatgaccggacagtaatgtgtccttttcttcggaacattggagacaggtggtgcatggttgtcgtcagctcgtgtcgtgagatgttgggttaagtcccgcaacgagcgcaacccctatcttcagtagccagcaagtaaagttgggcactctggagagactgccggggataacccggaggaaggcggggatgacgtcaaatcatcatgccccttatgaccagggctacacacgtgctacaatggcgtaaacagagggaagcgagagcgtgagctggagcaaatcccaaaaataacgtcccagttcggattgtagtctgcaactcgactacatgaagctggaatcgctagtaatcgcgaatcagcatgtcgcggtgaatacgttcccgggtcttgtacacaccgccgtcacaccatgggagtcggaaatgcccgaagtcggtgacctaaccgtaaggaaggagccgccgaagcaggtctgataactggggtgaagtcgtaaca

SEQ ID NO: 1061 - DNA, 1255 bp, Lachnospiraceae bacterium ICM62
acgctggcggcgtgcttaacacatgcaagtcgaacgagtggcggacgggtgagtaacgcgtggataacctgccttatacagggggataacggagagaaatttccgctaacaccgcataagaaaattaggtataagatggatccgcgtccgattagctagttggtgaggtaaaggcccaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgaactgacgttgaggctcgaaggcgtggggagcaaacaggattagataccctggtagtccacgcagtaaacgatgaatacttggtgtcggggcttcggtgccgcagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatatacaggtggtgcatggttgtcgtcagctcgtgtcgtgagatgttgggttaagtcccgcaacgagcgcaacccttgtcgtcagtagccagcatgggcactctgacgagacagccggagataatccggaggaaggtggggatgacgtcaaatcatcatgccccttatgatttgggctacacacgtgctacaatggcgtacaaagtgaagcaaagccgcgaggccaagcaaatcacaaaacgtctcagttcggatgtagtctgcaactcgactatagaagctggaatcgctagtaatcgcagatcagaatgctgcggtgaatacgttcccgggtcttgtacacaccgcccgtcacaccatgggagtcatcaatgcccgaagtcagtaccta

SEQ ID NO: 1062 - DNA, 1406 bp, Lachnospiraceae bacterium MSX33
ggcgtgcttaacacatgcaagtcgaacgaagctgcccaaaggaagttttcggatggaatttaggtagacttagtggcggacgggtgagtaacgcgtggataacctgccttatacagggggataacggagagaaatttccgctaacaccgcataagaccacagcaccgcatggtgcaggggtaaaatatttataggtataagatggatccgcgtccgattagctagttggtgaggtaaaggcccaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggggaggtaaactcttcggtgccgcaagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagctttgtaatgaagctagtccttcgggacaagggatacaggtggtgcatggttgtcgtcagctcgtgtcgtgagatgttgggttaagtcccgcaacgagcgcaacccttgtcgtcagtagccagcagtaagatgggcactctgacgagacagccggagataatccggaggaaggtggggatgacgtcaaatcatcatgccccttatgatttgggctacacacgtgctacaatggcgtaaacaaagtgaagcaaagccgcgaggtcaagcaaatcacaaaaataacgtctcagttcggattgtagtctgcaactcgactatatgaagctggaatcgctagtaatcgcagatcagaatgctgcggtgaatacgttcccgggtcttgtacacaccgcccgtcacaccatgggagtcatcaatgcccgaagtcagtgacctaaccgtaagga

SEQ ID NO: 1063 - DNA, 1536 bp, Lachnospiraceae bacterium oral taxon 107
ttttatatgagagtttgatcctggctcaggatgaacgctggcggcgtgcttaacacatgcaagtcgaacgaagctgcttaaaggaagttttcggatggaatttaggtagacttagtggcggacgggtgagtaacgcgtggataacctgccttatacagggggataacggagagaaatttccgctaacaccgcataagaccacagcaccgcatggtgcaggggtaaaatatttataggtataagatggatccgcgtccgattagctagttggtgaggtagaggctcaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggagaggtaaactcttcggtgccgcaagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagtcttgtaatgagactagtccttcgggacaagggatacaggtggtgcatggttgtcgtcagctcgtgtcgtgagatgttgggttaagtcccgcaacgagcgcaacccttgtcgtcagtagccagcagtaagatggggactctgacgagacagccggagataatccggaggaaggtggggatgacgtcaaatcatcatgccccttatgatttgggctacacacgtgctacaatggcgtaaacaaagtgaagcaaagctgcgaagccaagcaaatcacaaaaataacgtctcagttcggattgtagtctgcaactcgactatatgaagctggaatcgctagtaatcgcagatcagaatgctgcggtgaatacgttcccgggtcttgtacacaccgcccgtcacaccatgggagtcatcaatgcccgaagtcagtgacctaaccgtaaggaaggagctgccgaaggcagggaggataactggggtgaagtcgtaacaaggtagccgtatcggaaggtgcggctggatcacctcctttct

SEQ ID NO: 1064 - DNA, 1487 bp, Lachnospiraceae bacterium oral taxon F15
agagtttgatcctggctcaggatgaacgctggcggcgtgcttaacacatgcaagtcgaacgaagcatttagaagttttcggacggaagaatgacttagtggcggacgggtgagtaacgcgtgggtaacctgccttatacagggggataacagttggaaacgactgctaataccgcataacccgatagagtcgcatgacttagtcggaaaagatttatcggtataagatggacccgcgtctgattagctagttggtgaggtaatggcccaccaaggcgacgatcagtagccggcttgagagagtgaacggccacattgggactgagacacggcccaaactcctacgggaggcagcagtggggaatattgcacaatgggggaaaccctgatgcagcaacgccgcgtgaaggatgaagtatttcggtatgtaaacttctatcagcagggaagaaattgacggtacctgactaagaagccccggctaactacgtgccagcagccgcggtaatacgtagggggcaagcgttatccggatttactgggtgtaaagggagcgtaggcggcaatgcaagtccgatgtgaaagcccggggctcaaccccgggactgcattagaaactgtgttgctagagtgcaggagaggtaagtggaattcctagtgtagcggtgaaatgcgtagatattaggaggaacaccagtggcgaaggcgacttactggactgaaactgacgctgaggctcgaaagcgtggggagcaaacaggattagataccctggtagtccacgccgtaaacgatgaatactaggtgtcggggcccatccgggcttcggtgccgcggctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaccgtcccgtaacggggacttctcttcggagcaatggagacaggtggtgcatggttgtcgtcagctcgtgtcgtgagatgttgggttaagtcccgcaacgagcgcagcccttatctttagtagccagcatttaaggtgggcactctagagagactgccggggataacccggaggaaggcggggatgacgtcaaatcatcatgccccttatgatttgggctacacacgtgctacaatggcgtaaacaaagggaagcaacagggtgacctcaagcaaatcccaaaaataacgtcccagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagtcagtgacccaaccgcaaggagggagctgccgaaggtggagccgataactggggtgaagtcgtaacaaggtagccgt

SEQ ID NO: 1065 - DNA, 1330 bp, Lachnospiraceae genomosp. C1
gatgaacgctggcggcgtgcttaacacatgcaagtcgaacgaatggcggacgggtgagtaacgcgtgggtaacctgcctcatacagggggataacagttggaaacgactgttaataccgcataagaaaaagtggtatgagatggacccgcgttcgattagccagttggcggggtaacggcccaccaaagcgacgatcgatagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacggtacctgagtaagaagccccggctaactacgtgccagcagccgcggtaatacgtagggggcaagcgttatccggatttactgggtgtaaagggagcgcagacggctctgcaagtctgaagtgaaagcccgcggcttaaccgcgggactgctttggaaactgcaaggcttgagtatcggaggggcaggcggaattcctagtgtagcggtgaaatgcgtagatattaggaagaacaccggtggcgaaggcggcctgctggacgaactgacgttgaggctcgaaggcgtggggagcaaacaggattagataccctggtagtccacgcggtaaacgatgaatactaggtgttggtgcatcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccctattgccggtagccagcagctgggcactccggcgagactgcccgggataaccgggaggaaggcggggatgacgtcaaatcatcatgccccttatgatttgggcaacacacgtgctacaatggcgttcaaagagaagcgagaacgcgagtttaagcaaagctcaaaacgtctcagttcggatgcagtctgcaactcgactgcagaagctggaattgctagtaatcgcgaatcagcatgtcgcggtgaatacgttcccgggtcttgtacacaccgcccgtcacaccatgggagtcagcaacgcccgaagtcggtacccagggagctgccgaaggcggggcggataactggggtgaagtcgtaacaaggtagccgtatcggaaggtgc

SEQ ID NO: 1066 - DNA, 1406 bp, Lactobacillus acidipiscis
  modified_base (69)..(69): a, c, t, g, unknown or other
  modified_base (461)..(461): a, c, t, g, unknown or other
  modified_base (651)..(651): a, c, t, g, unknown or other
  modified_base (678)..(678): a, c, t, g, unknown or other
  modified_base (828)..(828): a, c, t, g, unknown or other
  modified_base (1221)..(1221): a, c, t, g, unknown or other
  modified_base (1223)..(1223): a, c, t, g, unknown or other
  modified_base (1242)..(1242): a, c, t, g, unknown or other
  modified_base (1247)..(1247): a, c, t, g, unknown or other
  modified_base (1268)..(1268): a, c, t, g, unknown or other
  modified_base (1282)..(1282): a, c, t, g, unknown or other
  modified_base (1287)..(1287): a, c, t, g, unknown or other
  modified_base (1321)..(1321): a, c, t, g, unknown or other
  modified_base (1386)..(1386): a, c, t, g, unknown or other
acgctggcggcgtgcctaatacatgcaagtcgaacgcaatctttgaccaatgagtgcttgcactcagcngtcaaagtgcgagtggcgaacgggtgagtaacacgtgggcaatctgcccaaaagtgggggataacacttggaaacaggtgctaataccgcatcaaccggctgaccgcatggtcggccgggcaaagacggcgtcagctgtcgcttttggatgagcccgcggcgtattaactagttggtaaggtaacggcttaccaaggtgatgatacgtagccgaactgagaggttgatcggccacattgggactgagacacggcccaaactcctacgggaggcagcagtagggaatcttccacaatggacgcaagtctgatggagcaacgccgcgtgtatgaagaaggtcttcggatcgtaaaatactgttgtcagagaagaacacgtgatagagtaactgntatggcgctgacggtatctgaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagaagtgcattggaaactggaagacttgagtgcanaagaggagagtggaactccatgtgtancggtgaaatgcgtaaatatatggaagaacaccagtggcgaaagcggctctctggtctgtaactgacgctgaggttcgaaagcgtggggagcgaacaggattagataccctggtagtccacgctgtaaacgatgaatgctaggtgttgganggtttccgcccttcggtgccgcagctaacgcactaagcattccgcctggggagtacgatcgcaagattgaaactcaaaggaattgacgggggcccgcacaagcggtggagcatgtggtttaattcgaagcaacgcgaagaaccttaccaggtcttgacatcttttgaccatctgagagatcagaatttcccttcggggacaaaatgacaggtggtgcatggctgtcgtccagctcgtgttcgtgagatgttgggttaagtcccgcaacgagcgcaacccttattgtcagttgccagcattcagttgggcactctggcgagactgccggtgacaaaccggaggaaggtggggatgacgtcaagtcatcatgccccttatgacctgggctacacncntgctacaatggacgatacnacgantcgcgagaccgcgaggtttanctaatctctgaaantcgtnctcagttcggatcgtaggctgcaactcgcctacntgaagtcggaatcgctagtaatcgcggatcagcatgccgcggtgaatacgttcccgggccttgtncacaccgcccgtcacaccat

SEQ ID NO: 1067 - DNA, 1421 bp, Lactobacillus acidophilus
agcgagctgaaccaacagattcacttcggtgatgacgttgggaacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctaatgcaatccgtagagatacgtatttcccttcggggacactaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacagtacaacgaggagcaagcctgcgaaggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagcc

SEQ ID NO: 1068 - DNA, 1515 bp, Lactobacillus alimentarius
  modified_base (1)..(1): a, c, t, g, unknown or other
  modified_base (82)..(82): a, c, t, g, unknown or other
  modified_base (214)..(214): a, c, t, g, unknown or other
  modified_base (217)..(217): a, c, t, g, unknown or other
  modified_base (260)..(260): a, c, t, g, unknown or other
  modified_base (359)..(360): a, c, t, g, unknown or other
  modified_base (765)..(765): a, c, t, g, unknown or other
  modified_base (767)..(767): a, c, t, g, unknown or other
  modified_base (957)..(957): a, c, t, g, unknown or other
  modified_base (992)..(992): a, c, t, g, unknown or other
ntaatatgagagtttgatcctggctcaggacgaacgctggcggcatgcctaatacatgcaagtcgaacgaactttcctattnattgatgcttgcatcatgatttagatctaagtgagtggcggacgggtgagtaacacgtgggtaacctgcccagaagtgggggataacatttggaaacaagtgctaataccgcataacaacattaaacacatnttntttgtttaaaagatggttttgctatctcttctggatggacccncggcgtattagctagttggtgaggtaatagctcaccaaggcgatgatacgtagccgacctgagagggtaatcggccacattgggactgagacacggccnnaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcggttcattaagtttgaagtgaaagccctcggctcaaccgaggaagtgcttcgaaaactggtgaacttgagtgcagaagaggaaagtggaactccatgtgtagcggtggaatgcgtagatatatggaagaacaccagtggcgaaggcggctttctngnctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggccngcacaagcggtggagcatgtggtttaattcgaagnaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattaggg

SEQ ID NO: 1069 - DNA, 1561 bp, Lactobacillus amylolyticus
tgagagtttgatcctggctcaggacgaacgctggcggcgtgcctaatacatgcaagtcgagcgagcagaactaacagatctacttcggtagtgacgtttcggaagcgagcggcggatgggtgagtaacacgtgggtaacctgcccttaagtctgggataccacttggaaacaggtgctaataccggataacaacaagtgctgcatggcacttgcttgaaaggcggcgcaagctgtcgctaaaggatggacccgcggtgcattagctagttggtaaggtaacggcttaccaaggcaacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagccctcggcttaaccggggaattgcatcggaaactgtttttcttgagtgcagaagaggagagtggaactccatgtgtagcggtggaatgcgtagatatatggaggaacaccagtggcgaaggcggctctctggtctgtaactgacgctgaggctcgaaagcatgggtagcgaacaggattagataccctggtagtccatgccgtaaacgatgagtgctaagtgttgggaggcttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaatccgtagagatacggagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggacgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggtcttgtacacaccgcccgtcacaccatgggagtctgcaatgcccgaagccggtggcctaaccttcgggaaggagccgtctaaggcagggcagatgactggggtgaagtcgtaacaaggtagccgtaggagaacctgcggctggatcacctcctttct

SEQ ID NO: 1070 - DNA, 1575 bp, Lactobacillus amylovorus
tttaaaatgagagtttgatcctggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataataaagcagatcgcatgatcagcttttgaaaggcggcgtaagctgtcgctaagggatggccccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatctgtagagatacggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttctaaggaag

SEQ ID NO: 1071 - DNA, 938 bp, Lactobacillus antri
  modified_base (16)..(16): a, c, t, g, unknown or other
  modified_base (18)..(18): a, c, t, g, unknown or other
  modified_base (20)..(21): a, c, t, g, unknown or other
  modified_base (603)..(603): a, c, t, g, unknown or other
  modified_base (642)..(642): a, c, t, g, unknown or other
  modified_base (661)..(661): a, c, t, g, unknown or other
  modified_base (699)..(699): a, c, t, g, unknown or other
  modified_base (768)..(768): a, c, t, g, unknown or other
  modified_base (777)..(777): a, c, t, g, unknown or other
  modified_base (798)..(798): a, c, t, g, unknown or other
  modified_base (836)..(836): a, c, t, g, unknown or other
  modified_base (844)..(844): a, c, t, g, unknown or other
  modified_base (855)..(855): a, c, t, g, unknown or other
  modified_base (913)..(913): a, c, t, g, unknown or other
  modified_base (916)..(916): a, c, t, g, unknown or other
  modified_base (918)..(919): a, c, t, g, unknown or other
  modified_base (931)..(931): a, c, t, g, unknown or other
tgcactgaattgacgntngnntcccagtgagcggcggacgggtgagtaacacgtgggcaacctgccctgaagcgggggataacatctggaaacaggtgctaataccgcataacaacgaaaaccacatggttttcgtttcaaagatggtttcggctatcacttcaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaanaggacagtggaactccatgtgtagcggtggaatgcgtanatatatggaagaacaccantggcgaaggcggctgtctggtctgcaactgacgctgangctcgaaagcatgggtagcgaacaggattagataccctggtagtccatgccgtaaacgatgagtgctangtgttgganggtttccgcccttcagtgccngagctaacgcattaagcactccgcctggggagtacgancgcaaggntgaaactcaanggaattgacgggggcccgcacaagcggtggagcatgtggtttaattcgaagctacgcnaanannttaccaggtctngacatct

SEQ ID NO: 1072 - DNA, 1430 bp, Lactobacillus brevis
gaacgagcttccgttgaatgacgtgcttgcactgatttcaacaatgaagcgagtggcgaactggtgagtaacacgtgggaaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaa

SEQ ID NO: 1073 - DNA, 1578 bp, Lactobacillus buchneri
tttaagatgagagtttgatcctggctcaggacgaacgctggcggcgtgcctaatacatgcaagtcgaacgcgtcttggtcaatgaagttgagtgcttgcatttaactgatttgacattaagacgagtggcgaactggtgagtaacacgtgggtaacttgccccgaagcgggggataacatttggaaacaggtgctaataccgcataacaacaaaaaccacatggtttttgtttaaaagatggtttcggctatcactttgggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttct

SEQ ID NO: 1074 - DNA, 1573 bp, Lactobacillus casei
tttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttct

SEQ ID NO: 1075 - DNA, 1544 bp, Lactobacillus catenaformis
  modified_base (67)..(67): a, c, t, g, unknown or other
  modified_base (319)..(319): a, c, t, g, unknown or other
  modified_base (327)..(328): a, c, t, g, unknown or other
  modified_base (373)..(373): a, c, t, g, unknown or other
  modified_base (581)..(581): a, c, t, g, unknown or other
  modified_base (602)..(605): a, c, t, g, unknown or other
  modified_base (639)..(639): a, c, t, g, unknown or other
  modified_base (753)..(756): a, c, t, g, unknown or other
  modified_base (920)..(921): a, c, t, g, unknown or other
  modified_base (1432)..(1432): a, c, t, g, unknown or other
  modified_base (1473)..(1473): a, c, t, g, unknown or other
  modified_base (1479)..(1479): a, c, t, g, unknown or other
  modified_base (1488)..(1496): a, c, t, g, unknown or other
  modified_base (1505)..(1529): a, c, t, g, unknown or other
tggagagtttgatcctggctcaggatgaacgctggcggcgtgcctaatacatgcaagtcgaacgggntgccattaggcactagtggcgaacgggtgaggagcacatggggaacctgcccgtcagagggggacaacagctggaaacggctgctaagaccgcataggctcaaggagggcatcctcgttgagttaaagtgtcctttcggggacagctgacggatggacctgtggcgcattagctagttggcggggtaaaggcccaccaaggcgacgatgcgtagccggcctgagagggcggacggccacactgggactgagncacggccnngactcctgcgggaggcagcagtagggaattttcggcaatgggggnaaccctgaccgagcaacgccgcgtgagtgaggaaggccttcgggctgtaaagctctgttgcagaggaagaacgggagagcgaggaaatgcgcttttcgtgacggtactctgcgagaaagccacggctaactacgtgccagcagccgcggtaatacgtaggtggcgagcgttatccggaatcattgggcgtaaagagggagcaggcggnacgcgaaggtccgtagtaaannnngaagctaaacttcgggcggctatggaaaccgcgncgcctggagtgcggaagaggaactcggaattccatgtgtagcggtgaaatgcgtagatatatggaggaacaccggtggcgaaggcggcggtctggtccggcactgacgctcagnnnngaaagcgtggggagcaaataggattagataccctagtagtccacgctgtaaacgatcgataccaggtgtcgggagtcacatcccggtgccgaagccaacgcattaagtatcgcgcctgagtagtacgtccgcaaggatgaaactcaaaggaattgacgggggcnngcacaagcggtggagcatgtggtttaattcgaagcaacgcgaagaaccttaccaggccttgacatcgatccgatcgcgcggagacgcgcgagaccttgccgaaagggaaggaggagaagacaggtggtgcatggttgtcgtcagctcgtgtcgtgagatgttgggttaagtcccgcaacgagcgcaacccctgccgccagttgccagcattcaggatggggactctggcgggactgcccctgtaagggggaggaaggcggggatgacgtcaaatcatcatgccccttatggcctgggctacacacgtgctacaatggacggagcagagggaggcgaagccgcgaggcggagcggagcccagaaacccgttcacagttcggactgcagcctgcaactcggctgcacgaagctggaatcgctagtaatcgcagatcagcatgctgcggtgaatacgttcccgggccttgtacacaccgcccgtcacaccatgagagtcggcaacgcccgaagncggcggcccaaccccgtaaggggagggagcagtcaaaggcngggcanatgattggnnnnnnnnngtaacaagnnnnnnnnnnnnnnnnnnnnnnnnngatcacctcctttct

SEQ ID NO: 1076 - DNA, 1573 bp, Lactobacillus coleohominis
tgagagtttgatcctggctcaggatgaacgccggcggtgtgcctaatacatgcaagtcgaacgcgttggcccgactgattgatgatgcttgcatcagattgacgacggtttaccaacgagtggcggacgggtgagtaacacgtaggcaacctgcccagaagcgggggacaacatttggaaacaagtgctaataccgcataacaacgaaaactgcctggttttcgtttaaaagatggtttcggctatcacttctggatgggcctgcggcgcattagctagttggtaaggcaacggcttaccaaggcagtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccggagaagggcatcggaaactggataacttgagtgcaagagaggacagtggaactccatgtgtagcggtggaatgcgtagatatatggaagaacaccagtggcgaaggcggctgtctagcttgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagcagcgaactcgcaagggccagctaatctcttaaaaccgttctcagttcggactgcagtctgcaactcgactgcacgaagtcggaatcgctagtaatcgcggatcagcatgccgcggtgaatacgttcccgggccttgtacacaccgcccgtcacaccatgggagtttgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 1077 - DNA, 1518 bp, Lactobacillus coryniformis
  modified_base (1)..(2): a, c, t, g, unknown or other
  modified_base (116)..(116): a, c, t, g, unknown or other
  modified_base (150)..(151): a, c, t, g, unknown or other
  modified_base (220)..(220): a, c, t, g, unknown or other
  modified_base (247)..(247): a, c, t, g, unknown or other
  modified_base (263)..(263): a, c, t, g, unknown or other
  modified_base (362)..(363): a, c, t, g, unknown or other
  modified_base (464)..(464): a, c, t, g, unknown or other
  modified_base (573)..(573): a, c, t, g, unknown or other
  modified_base (639)..(639): a, c, t, g, unknown or other
  modified_base (763)..(763): a, c, t, g, unknown or other
  modified_base (790)..(790): a, c, t, g, unknown or other
  modified_base (792)..(793): a, c, t, g, unknown or other
  modified_base (960)..(960): a, c, t, g, unknown or other
  modified_base (995)..(995): a, c, t, g, unknown or other
  modified_base (1080)..(1080): a, c, t, g, unknown or other
  modified_base (1181)..(1181): a, c, t, g, unknown or other
  modified_base (1391)..(1391): a, c, t, g, unknown or other
  modified_base (1416)..(1416): a, c, t, g, unknown or other
  modified_base (1430)..(1430): a, c, t, g, unknown or other
  modified_base (1436)..(1436): a, c, t, g, unknown or other
  modified_base (1497)..(1497): a, c, t, g, unknown or other
  modified_base (1511)..(1511): a, c, t, g, unknown or other
  modified_base (1514)..(1515): a, c, t, g, unknown or other
nnttatatgagagtttgatcctggctcaggacgaacgctggcggcgtgcctaatacatgcaagtcgaacgcactgacgtcgaccgaagctgcttgcagtggacgttgattgacgtnagtggcggacgggtgagtaacacgtgggtaaccnncccttaagtgggggataacatttggaaacagatgctaataccgcataaccattcagaccacatggtctnaatgtaaaagacggcctttggctgtcncttttggacggacccncggcgtattagttagttggtaaggtaacggcttaccaagacaatgatacgtagccgacctgagagggtaatcggccacattgggactgagacacggccnnaactcctacgggaggcagcagtagggaatcttccacaatggacgaaagtctgatggagcaacgccgcgtgagtgaagaaggttttaggatcgtaaaactcngttgttggagaagaacagggactagagtaactgttagtcctttgacggtatccaaccagaaagccacggctaactacgtgccagcagccgcggtaatacgtaggtggcnagcgttgtccggatttattgggcgtaaagcgagcgcaggcggttttttaagtctgatgtgaaagcnttcggcttaaccgaagaagtgcattagaaactggraaacttgagtgcagaagaggacagtggaactccatgtgtagcggtgaaatgcgtagatatatggaagaacaccagtggcgaaggcggcngtctggtctgtaactgacgctgaggcncnnaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggccngcacaagcggtggagcatgtggtttaattcgaagnaacgcgaagaaccttaccaggtcttgacatcctttgaccactgtagagatacagctttcccttcggggacaaagtgacaggtggngcatggttgtcgtcagctcgtgtcgtgagatgttgggttaagtcccgcaacgagcgcaacccttatgactagttgccagcatttagttgggcactctagtnagactgccggtgacaaaccggaggaaggtggggatgacgtcaaatcagcatgccccttatgacctgggctacacacgtgctacaatggtcggtacaacgagttgcgaacccgcgagggtaagctaatctcttaaagccgatctcagttcggattgtaggctgcaactcgcctacatgaagccggaatcgctagtaatcgcggatcagcangccgcggtgaatacgttcccgggcnttgtacacaccgcncgtcanaccatgagagtttgtaacacccgaagtcggtggggtaacccttttagggaactagccgccnaaggtgggacagangannggg

SEQ ID NO: 1078 - DNA, 1562 bp, Lactobacillus crispatus
tgagagtttgatcctggctcaggacgaacgctggcggcgtgcctaatacatgcaagtcgagcgagcggaactaacagatttacttcggtaatgacgttaggaaagcgagcggcggatgggtgagtaacacgtggggaacctgccccatagtctgggataccacttggaaacaggtgctaataccggataagaaagcagatcgcatgatcagcttttaaaaggcggcgtaagctgtcgctatgggatggccccgcggtgcattagctagttggtaaggtaaaggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagtgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 1079 - DNA, 1559 bp, Lactobacillus curvatus
aagtttgattatagctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttcggaaacagatgctaataccgcataaaacctaacaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggatgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtagagaacctgcggctggatcacctct

SEQ ID NO: 1080 - DNA, 1568 bp, Lactobacillus delbrueckii
ttcaaattgagagtttgatcctggctcaggacgaacgctggcggcgtgcctaatacatgcaagtcgagcgagctgaattcaaagatcccttcggggtgatttgttggacgctagcggcggatgggtgagtaacacgtgggcaatctgccctaaagactgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggtcttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggcttaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggttctcagtgccgcagcaaacgcgttaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgctacacctagagataggtggttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcgaacccgcgagggtaagcggatctcttaaagctgctctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgagataacctttataggagtcagccgcctaaggcagggcagatgactggggtgaagtcgtaacaaggtagccgtaggagaacctgcggctggatcacctcctttct

SEQ ID NO: 1081 - DNA, 1464 bp, Lactobacillus dextrinicus
  modified_base (394)..(394): a, c, t, g, unknown or other
  modified_base (397)..(397): a, c, t, g, unknown or other
  modified_base (781)..(781): a, c, t, g, unknown or other
ctggcggcgtgcctaatacatgcaagtcgaacgagtttgcttttaatgaaggcggtgcttgcaccaactgatttaaaaataaacgagtggcggacgggtgagtaacacgtgggtaacctaccctaaagtgggggataacatttggaaacagatgctaataccgcataatatcaaaaaccacatggtttttaattgaaagacggcgtaagctgtcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacnccncgtgagtgaagaaggttttcggatcgtaaaactctgttattggagaagaacgtatttggtagtaactggccagatagtgacggtatccaatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacagnattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttattatcagttgccagcatttagttgggcactctggtgagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccgaagccggtggagtaacccgtaagggagctagccgtct

SEQ ID NO: 1082 - DNA, 1517 bp, Lactobacillus farciminis
  modified_base (1)..(2): a, c, t, g, unknown or other
  modified_base (154)..(154): a, c, t, g, unknown or other
  modified_base (297)..(297): a, c, t, g, unknown or other
  modified_base (360)..(361): a, c, t, g, unknown or other
  modified_base (551)..(552): a, c, t, g, unknown or other
  modified_base (571)..(571): a, c, t, g, unknown or other
  modified_base (761)..(761): a, c, t, g, unknown or other
  modified_base (956)..(958): a, c, t, g, unknown or other
  modified_base (993)..(993): a, c, t, g, unknown or other
  modified_base (1136)..(1136): a, c, t, g, unknown or other
  modified_base (1410)..(1410): a, c, t, g, unknown or other
  modified_base (1414)..(1414): a, c, t, g, unknown or other
  modified_base (1428)..(1430): a, c, t, g, unknown or other
nntaatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgccnaaaagtgggggataacatttggaaacaagtgctaataccgcataacaactactttcacatgatcgtagcttgaaagatggctctgctatcgcttttggatggacccgcggcgtattagctagttggtgaggtaatagctcacnaaggcaatgatacgtagccgacctgagagggtaatcggccacattgggactgagacacggccnnaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagctacggctaactacgtgccagcagcnncggtaatacgtaggtggcnagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggcnttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggnnngcacaagcggtggagcatgtggtttaattcgaagnaacgcgaagaaccttaccaggtcttgacataccatgacaaactaagagattagtctttcccttcggggacatggatacaggtggtgcatggttgtcgtcagctcgtgtcgtgagatgttgggttaagtcccgcaacgagcgcnacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccnggcnttgtacacaccgcnnntcacaccatgagagtttgtaacacccaaagtcggtggggtaacccttcggggaactagccgcctaaggtgggacaaatgattagggt

SEQ ID NO: 1083 - DNA, 1419 bp, Lactobacillus fermentum
  modified_base (1405)..(1405): a, c, t, g, unknown or other
tggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaacttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctagtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcatccaaccttaccaggtcttgacatcttgcgcccaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtanccttttaggagcca

SEQ ID NO: 1084 - DNA, 995 bp, Lactobacillus gasseri
  modified_base (43)..(43): a, c, t, g, unknown or other
  modified_base (50)..(50): a, c, t, g, unknown or other
  modified_base (918)..(918): a, c, t, g, unknown or other
  modified_base (976)..(976): a, c, t, g, unknown or other
  modified_base (984)..(984): a, c, t, g, unknown or other
gagcttgcctagatgaatttggtgcttgcaccaaatgaaactngatacangcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggnttaattcgaagcaacgcgaagaaccttaccaggtcttgacatccagtgcaaacctaanagattagnagttcccttcg

SEQ ID NO: 1085 - DNA, 1373 bp, Lactobacillus gastricus
tatatggagtttgatcctggctcaggatgaacgccggcggtgtgcctaatacatgcaagtcgaacgagtggcggacgggtgagtaacacgtaggtaacctgcccagaagcgggggataacatctggaaacaggtgctaataccgcataacaaaagtcacttctggatggacctgcggcgcattagcttgttggtagggtaatggcctaccaaggcagtgatgcgtagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttgaagaagatgacggtattcaaccagaaagtcacggctaactacgtgccagcagccgcggtaatacgtaggtggcaagcgttatccggatttattgggcgtaaagagagtgcaggcggtttcttaagtctgatgtgaaagccttcggctcaaccgaagaagtgcatcggaaactgggagacttgagtacagaagagggcagtggaactccatgtgtagcggtggaatgcgtagatatatggaagaacaccagtggcgaaggcggctgcctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgggacagatgattagggtgaagtcgtaacaaggtagccgtaggagaacctgcggctggatcacctcctttct

SEQ ID NO: 1086 - DNA, 1287 bp, Lactobacillus genomosp. C1
agtggcgaactggtgagtaacacgtgggtaacctgccctgaagtgggggataacacttggaaacaggtgctaataccgcataacgaaagtcacttttggatggacccgcggcgtattagcttgttggtgaggtaacggctcaccaaggccatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagatgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagggcatcggaaaccgggagacttgagtgcagaagaggacagtggaactccatgtgtagcggtgaaatgcgtagatatatggaagaacaccagtggcgaaggcggctgtctggtctgactgacgctgaggctcgaaagcatgggtagcgaacaggattagataccctggtagtccatgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcgacaggtggtgcatggttgtcgtcagctcgtgtcgtgagatgttgggttaagtcccgcaacgagcgcaacccttattgtcagttgccagcatgggcactctggcgagactgccggtgacaaaccggaggaaggtggggatgacgtcaaatcatcatgccccttatgacctgggctacacacgtgctacaatggacggcaacgagtcgcgaaaccgcgaggtcaagctaatctcttccgttctcagttcggatgccggctgcaactcgcctgcagaagttggaatcgctagtaatcgtggatcagcatgccacggtgaatacgttcccgggccttgtacacaccgcccgtcacaccatgagagtttgtaacacccaaagccggtaggtaaccagccgtctaaggtgggacagatgattagggtgaagtcgtaacaaggtagccgtaggagaacctgc

SEQ ID NO: 1087 - DNA, 1254 bp, Lactobacillus genomosp. C2
agtggcgaactggtgagtaacacgtgggtaacctgccctgaagtaggggataacacttggaaacaggtgctaataccgtataacaaaagtcactttaggatggacccgcggcgtattagcttgttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagatgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgactgacgctgaggctcgaaagcatgggtagcgaacaggattagataccctggtagtccatgccgtaaacgatgagtgctaagtgttggagcttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcgacaggtggtgcatggttgtcgtcagctcgtgtcgtgagatgttgggttaagtcccgcaacgagcgcaacccttattgttagttgccagcatgggcactctagcaagactgccggtgacaaaccggaggaaggtggggatgacgtcaaatcatcatgccccttatgacctgggctacacacgtgctacaatggacggcaacgagtcgcgaaaccgcgaggtcaagctaatctcttccgttctcagttcggatgtaggctgcaactcgcctacagaagttggaatcgctagtaatcgtggatcagcatgccacggtgaatacgttcccgggccttgtacacaccgcccgtcacaccatgagagtttgtaacacccaaagccggtaggtaaccagccgtctaaggtgggacagatgattagggtg

SEQ ID NO: 1088 - DNA, 1016 bp, Lactobacillus helveticus
  modified_base (797)..(799): a, c, t, g, unknown or other
  modified_base (979)..(979): a, c, t, g, unknown or other
  modified_base (983)..(986): a, c, t, g, unknown or other
  modified_base (1000)..(1000): a, c, t, g, unknown or other
gtcgagcgagcagaaccagcagatttacttcggtaatgacgctggggacgcgagcggcggatgggtgagtaacacgtggggaacctgccccatagcctgggataccacttggaaacaggtgctaataccggataagaaagcagatcgcatgatcagcttataaaaggcggcgtaagctgtcgctatgggatggccccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaattccatgtgtagcggtggaatgcgtagatatatggaagaacaccagtggcgaaggcgactctctggtctgcaactgacgctgaggctcgaaagcatgggtagcgaacaggattagataccctggtagtccatgccgtaaacgatgagtgctaagtgttnnnggtttccgcctctcagtgctgcagctaacgcatttaagcactccgcctggggagtacgaccgcaaggttgaaactcaaaggaattgacgggggcccgcacaagcggtggagcatgtggtttaattcgaagcaacgcgaagaacccttaccaggtcttgacatctagtgccatcctaaganattnnnnttcccttcggggangctaagacaggtggtg

SEQ ID NO: 1089 - DNA, 1572 bp, Lactobacillus hilgardii
tgagagtttgatcctggctcaggacgaacgctggcggcgtgcctaatacatgcaagtcgaacgcgtcttggtcaatgaagttgagtgcttgcatttaactgatttgacattaagacgagtggcgaactggtgagtaacacgtgggtaacttgccccgaagcgggggataacatttggaaacaggtgctaataccgcataacaacaaaaaccacatggtttttgtttaaaagatggtttcggctatcactttgggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttcta

SEQ ID NO: 1090 - DNA, 1718 bp, Lactobacillus hominis
tacacatggagttccactctcctcttctgcactcaagttcaacagtttctgatgcaattctccggttgagccgaaggctttcacatcagacttattgaaccgcctgcactcgctttacgcccaataaatccggacaacgcttgccacctacgtagagtttgatcatggctcaggacgaacgctggcggcgtgcctaatacatgcaagtcgagcgagcttgcctagatgatttcggtgcttgcaccgaatgaaactagatacaagcgagcggcggacgggtgagtaacacgtgggtaacctgcccaagagactgggataacacctggaaacagatgctaataccggataacaacatctagcgcatgctagaagtttgaaagatgggtttctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtggtgaagaaagatagaggtagtaactggcctttatttgacggtaatcacctagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgagataaccattaaaggagtcagccgtctaaggtaggacagatgattagggtgaagtcgtaacaaggtagccgtaggagaacctgcggttggatcacctcctta

SEQ ID NO: 1091 - DNA, 1572 bp, Lactobacillus iners
aaattgagagtttgatcctggctcaggacgaacgctggcggcgtgcctaatacatgcaagtcgagcgagtctgccttgaagatcggagtgcttgcactctgtgaaacaagatacaggctagcggcggacgggtgagtaacacgtgggtaacctgcccaagagatcgggataacacctggaaacagatgctaataccggataataacagatgatgcctatcaactgtttaaaagatggttctgctatcactcttggatggacctgcggtgcattagctagttggtagggtaacggcctaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttgttggtgaagaaggacaggggtagtaactgacctttgtttgacggtaatcaattagaaagtcacggctaactacgtgccagcagccgcggtaatacgtaggtggcaagcgttgtccggatttattgggcgtaaagcgagtgcaggcggctcgataagtctgatgtgaaagccttcggctcaaccggagaattgcatcagaaactgtcgagcttgagtacagaagaggagagtggaactccatgtgtagcggtgaaatgcgtagatatatggaagaacaccggtggcgaaggcggctctctggtctgttactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccttgtacacaccgcccgtcacaccatgagagtctgtaacgcccgaagccggcgggataaccgaaaggagtcagccgtctaaggcgggacagatgattagggtgaagtcgtaacaaggtagccgtaggagaacctgcggctggatcacctcctttct

SEQ ID NO: 1092 - DNA, 1567 bp, Lactobacillus jensenii
ttcaaaatgagagtttgatcctggctcaggacgaacgctggcggcgtgcctaatacatgcaagtcgagcgagcttgcctatagaaattcttcggaatggacatagatacaagctagcggcggatgggtgagtaacgcgtgggtaacctgcccttaagtctgggataccatttggaaacagatgctaataccggataaaagctactttcgcatgaaagaagtttaaaaggcggcgtaagctgtcgctaaaggatggacctgcgatgcattagctagttggtaaggtaacggcttaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggttttcccttcggggacaaagagacaggtggtgcatggctgtcgtcagctcgtgtcgtgagatgttgggttaagtcccgcaacgagcgcaacccttgttaatagttgccagcattaagttgggcactctattgagactgccggtgacaaaccggaggaaggtggggatgacgtcaagtcatcatgccccttatgacctgggctacacacgtgctacaatgggcagtacaacgagaagcgaacctgtgaaggcaagcggatctcttaaagctgttctcagttcggactgtaggctgcaactcgcctacacgaagctggaatcgctagtaatcgcggatcagcacgccgcggtgaatacgttcccgggccttgtacacaccgcccgtcacaccatgagagtttgtaacacccaaagtcggtgaggtaacctttggagccagccgcctaaggtgggacagatgattagggtgaagtcgtaacaaggtagccgtaggagaacctgcggctggatcacctcctttct

SEQ ID NO: 1093 - DNA, 1651 bp, Lactobacillus johnsonii
agctaaacgataaaaagctcattttcaaaaggaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaaggcgaaagatgatggagagtgcgagagcactaagagaag

SEQ ID NO: 1094 - DNA, 1555 bp, Lactobacillus kalixensis
ttgatcctggctcaggacgaacgctggcggcgtgcctaatacatgcaagtcgagcgaacagaagcagcagaattacttcggtaaggacgctgtggaagttagcggcggatgggtgagtaacacgtgggtaacctacccttaagactgggataccacttggaaacaggtgctaataccggataggagtatgagctgcatggcttatactttaaaggcggcgaaagctgtcactaaaggatggacccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatataggtagtaactggcctatatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagcccacggctcaaccgtggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccattctaagagattagaagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatgggcagtacaacgagaagcaagccggtgacggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgtaaggaaggagccgtctaaggcagggcagatgactggggtgaagtcgtaacaaggtagccgtaggagaacctgcggctggatcacctccttttct

SEQ ID NO: 1095 - DNA, 1552 bp, Lactobacillus kefiranofaciens
agtttgattcttgctcaggacgaacgctggcggcgtgcctaatacatgcaagtcgagcgagcggaaccagcagaatcacttcggtgaggacgctgggaaagcgagcggcggatgggtgagtaacacgtggggaacctgcccttaagtctgggataccacttggaaacaggtgctaataccggataagaaagcagttcgcatgaacagcttttaaaaggcggcgcaagctgtcgctaaaggatggacccgcggtgcattagctagttggtaaggtaacggcctaccaaggcagtgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggaccgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaattgcatcggaaactgtttttcttgagtgcagaagaggagagtagaactccatgtgtagcggtggaatgcgtagatatatggaagaataccagtggcgaaggcggctctctggtctgcaactgacgctgaggctcgaaagcatgggtagcgaacaggattagataccctggtagtccatgccgtaaacgatgagtgctaagtgttgggaggcttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagcacaacgagcagcgagcctgcaaaggcaagcaaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgcaaggaaggagccgtctaaggcagggcagatgactggggtgaagtcgtaacaaggtagccgtaggagaacctgcggctggatcacctct

SEQ ID NO: 1096 - DNA, 1456 bp, Lactobacillus kefiri
gtcgaacgcgtttccgttattgattttaggtgcttgcatttagaatgatttaacacggaaacgagtggcgaactggtgagtaacacgtgggtaacctgcccttgaagtaggggataacacttggaaacaggtgctaataccgtataacaaccaaaaccacatggttttggtttaaaagatggcttcggctatcactttaggatggacccgcggcgtattagcttgttggtaaggtaatggcctaccaaggcaatgatacgtagccgacctgagagggtaatcggccacattgggactgagacacggcccaaactcctacgggaggcagcagtatggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtggacagatga

SEQ ID NO: 1097 - DNA, 1522 bp, Lactobacillus kimchii
gacgaacgctggcggcatgcctaatacatgcaagtcgaacgaaccatcctgaagattgaagcttgcttcatgattcagaccttggtgagtggcggacgggtgagtaacacgtgggtaacctgcccagaagtgggggataacatttggaaacaagtgctaataccgcataacaacttagatcacatgatctttgtttaaaagatggttttgctatctcttctggatggacccgcggcgtattagctagttggtgaggtaatagctcaccaaggcgatgatacgtagccgacctgagagggtaatcggccacattgggactgagacacggcccaaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgc

SEQ ID NO: 1098 - DNA, 1479 bp, Lactobacillus leichmannii
gacgaacgctggcggcgtgcctaatacatgcaagtcgagcgagctgaattcaaagatcccttcggggtgatttgttggaygctagcggcggatgggtgagtaacacgtgggcaatctgccctaaagactgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggtyttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgctacacytagagatargtggttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcraacccgcgagggtaagcggatctcttaaagctgytctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgsgataacctttataggagtcagccgcctaaggcagggcagatgac

SEQ ID NO: 1099 - DNA, 1308 bp, Lactobacillus mucosae
agcgagtggcggacgggtgagtaacacgtaggtaacctgccccaaagcgggggataacatttggaaacagatgctaataccgcataacaatttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagaacgtgcgtgagagcaactgttcacgcagtgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcggaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagctaatctcttaaaaccgttctcagttcggactgcaggctgcaactcgcctgcacgaagtcggaatcgctagtaatcgcggatcagcatgccgcggtgaatacgttcccgggccttgt

SEQ ID NO: 1100 - DNA, 1022 bp, Lactobacillus murinus
  modified_base (989)..(989): a, c, t, g, unknown or other
  modified_base (998)..(1001): a, c, t, g, unknown or other
  modified_base (1003)..(1004): a, c, t, g, unknown or other
  modified_base (1011)..(1012): a, c, t, g, unknown or other
cttctttatcaccgagtgcttgcactcaccgataaagagttgagtggcgaacgggtgagtaacacgtgggcaacctgcccaaaagagggggataacacttggaaacaggtgctaataccgcataaccatagttaccgcatggtaactatgtaaaaggtggctatgctaccgcttttggatgggcccgcggcgcattagctagttggtgaggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaatcctagagataggactttcccttcgggganagaatgacnnnngnncatggtnntcgtcagctc

SEQ ID NO: 1101 - DNA, 1556 bp, Lactobacillus nodensis
cctggctcaggacgaacgctggcggcgtgcctaatacatgcaagtcgagcgaactctggtttttgaacgatggtgcttgcaccggagtgattaaacatttgagtgagcggcggatgggtgagtaacacgtgggtaacctgccctaaagtgggggataacatttggaaacaagtgctaataccgcataacaacatttaccacatggtttatgtttgaaagatggttctgctatcgctttaggatggacccgcggtgcattagttagttggtgaggtaacggctcaccaagaccgtgatgcatagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacatcagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaccttttaggagctagccgtctaaggtgggacaaatgattagggtgaagtcgtaacaaggtagccgtaggagaacctgcggctggatcacctcctac

SEQ ID NO: 1102 - DNA, 1556 bp, Lactobacillus oeni
tagattttgatcctggctcaggacgaacgctggcggcgtgcctaatacatgcaagtcgaacgcagaatttccaccgagtgcttgcactcaccggaaattctgagtggcgaacgggtgagtaacacgtgggtaacctgcccaaaagagggggataacacttggaaacaggtgctaataccgcataacaacaaaaaccgcctggtttttgtttcaaagatggtttcggctgtcacttttggatggacccgcggcgtattagctagttggtaaggtaacggcttaccaaggcagtgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggtcttttaagtctgatgtgaaagccttcggcttaaccgaagtcgtgcattggaaactgagagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgctaacctgagagatcaggcgttcccttcggggacaaaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtgcggtaaccttttaggaaccagccgtctaaggtgggacagatgattggggtgaagtcgtaacaaggtagccgtaggagaacctgcggctggaccacctacttaa

SEQ ID NO: 1103 - DNA, 1579 bp, Lactobacillus oris
ttttatatgagagtttgatcctggctcaggatgaacgccggcggtgtgcctaatacatgcaagtcgagcgcactggcccaacagaaatgacgtgcttacactgatttgacgttggattcccagtgagcggcggacgggtgagtaacacgtgggcaacctgccccaaagcgggggataacatttggaaacaggtgctaataccgcataacttggaaaaccacatggttttccaataaaagatggtttcggctatcactttgggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttggagaagaacgtgcgtaagagtaactgtttacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgaagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaaagacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggccggtacaacgagcagctaacccgcgagggtgtgcaaatctcttaaagccggtctcagttcggactgcagtctgcaactcgactgcacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagatgactggggtgaagtcgtaacaaggtagccgtaggagaacctgcggctggatcacctcctttct

SEQ ID NO: 1104 - DNA, 1518 bp, Lactobacillus parabrevis
gacgaacgctggcggcatgcctaatacatgcaagtcgaacgagcttccgttgaatgacgtgcttgcactgatttyaacaatgaagcgagtggcgaactggtgagtaacacgtgggtaacttgcccagaagcaggggataacacttggaaacaggtgctaataccgtataacaacagaaaccgcatggtttctgtttgaaaggtggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtygcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacc

SEQ ID NO: 1105 - DNA, 1556 bp, Lactobacillus parabuchneri
ttgatcctggctcaggacgaacgctggcggcgtgcctaatacatgcaagtcgaacgcgtcttggttattgatgttaagtgcttgcatttaactgatttaacattgagacgagtggcgaactggtgagtaacacgtgggtaacctgcccttgaagtaggggataacacttggaaacaggtgctaataccgtataacaaccaaaaccacctggttttggtttaaaagatggcttcggctatcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtgagagtaactgttcacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcac

SEQ ID NO: 1106 - DNA, 1410 bp, Lactobacillus paracasei
  modified_base (1402)..(1402): a, c, t, g, unknown or other
tcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggacatgtggtttaattcgaagcaacgcgaagaacttaccaggtcttgacatcttttgatcacctgagagatcccgttacccattggggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaaccctntagggagc

SEQ ID NO: 1107 - DNA, 1396 bp, Lactobacillus parakefiri
  modified_base (51)..(51): a, c, t, g, unknown or other
gacgaacgctggcggcgtgcctaatacatgcaagtcgaacgcgtcttggcnaatgattttaggtgcttgcacttgaaagatttgacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaaccgttgtcagagcaactgttgacagcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccggcctt

SEQ ID NO: 1108 - DNA, 1308 bp, Lactobacillus pentosus
gagtttgatcatggctcaggacgaacgctggcggcgtgcctaatacatgcaagtcgaacgagtggcgaactggtgagtaacacgtgggaaacctgcccagaagcgggggataacacctggaaacagatgctaataccgcataacgaaagtcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgggacagatgatt

SEQ ID NO: 1109 - DNA, 1554 bp, Lactobacillus perolens
tggctcaggacgaacgctggcggcgtgcctaatacatgcaagtcgaacgaggtttgatcagtttgcggtggtgcttgcatcaccaattaccgattaaaccgagtggcggacgggtgagtaacacgtgggtaacctgcccttcagcaggggataacatttggaaacagatgctaataccgtataaccacggagaccgcatggtctccgggtaaaagatggcgaaagctatcactgagggatggacccgcggcgtattagccagttggtggggtaatggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgagagtaactgctcatgcagtgacggtattcaaccagaaagtcacggctaactacgtgccagcagccgcggtaatacgtaggtggcaagcgttgtccggatttattgggcgtaaagcgagtgcaggcggttttttaagtctgatgtgaaagccttcggcttaaccgaagaagtgcatcggaaagtgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgttggggggtttccgcccctcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaagctgagagatcagccgttccttcggggacagaatgacaggtggtgcatggttgtcgtcagctcgtgtcgtgagatgttgggttaagtcccgcaacgagcgcaacccttatgattagttgccagcattcagttgggcactctagtcagactgccggtgacaaaccggaggaaggcggggatgacgtcaaatcatcatgccccttatgacctgggctacacacgtgctacaatgggtggtacaacgagcagcgagaccgcgaggtcaagcgaatctctaaaaaccatcctcagttcggattgtaggctgcaactcgcctacatgaagctggaatcgctagtaatcgcggatcagcacgccgcggtgaatacgttcccgggccttgtacacaccgcccgtcacaccatgagagtttgtaacacccaaagccggtaggacaaccgcaaggagtcagccgtctaaggtgggacaaatgattagggtgaagtcgtaacaaggtagccgtaggagaacctgcggctggatcacctcctttct

SEQ ID NO: 1110 - DNA, 900 bp, Lactobacillus plantarum
  modified_base (19)..(19): a, c, t, g, unknown or other
  modified_base (32)..(32): a, c, t, g, unknown or other
  modified_base (44)..(44): a, c, t, g, unknown or other
  modified_base (74)..(74): a, c, t, g, unknown or other
  modified_base (87)..(87): a, c, t, g, unknown or other
  modified_base (99)..(99): a, c, t, g, unknown or other
  modified_base (123)..(123): a, c, t, g, unknown or other
  modified_base (133)..(134): a, c, t, g, unknown or other
  modified_base (151)..(151): a, c, t, g, unknown or other
  modified_base (153)..(153): a, c, t, g, unknown or other
  modified_base (203)..(203): a, c, t, g, unknown or other
  modified_base (382)..(382): a, c, t, g, unknown or other
  modified_base (882)..(884): a, c, t, g, unknown or other
  modified_base (886)..(888): a, c, t, g, unknown or other
gccgcggtaatacgtaggngcaagcgttgtcnggattattgggngtaaagcgagcgcaggcggttttttaagtntgatgtgaaagcnttcggctcaacngaagaagtgcatcggaaaactggnaaacttgagnncagaagaggacagtggnanctccatgtgtagcggtgaaatgcgtagatatatggaagaacaccagtggngaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggntgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccnnnannncatgagagtttg

SEQ ID NO: 1111 - DNA, 1395 bp, Lactobacillus pontis
agtgagcggcggacgggtgagtaacacgtgggcaacctgccctggagcgggggataacatttggaaacagatgctaataccgcataataatcaaaaccacatggttttgatttcaaagatggcttcggctatcactccaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcatgcagtgacggtattcaaccagaaagtcacggctaactacgtgccagcagccgcggtaatacgtaggtggcaagcgttatccggatttattgggcgtaaagcgagcgcaggcggttacttaagtctgatgtgaaagccttcggcttaaccgaagaagtgcatcggaaactgggtgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggatgacgtcagatcatcatgccccttatgacctgggctacacacgtgctacaatggtcggtacaacgagtcgctaacccgcgagggcaagctaatctcttaaagccgatctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagat

SEQ ID NO: 1112 - DNA, 1580 bp, Lactobacillus reuteri
ttttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtcctcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttct

SEQ ID NO: 1113 - DNA, 1429 bp, Lactobacillus rhamnosus
gtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctagtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggttgcccgtgtggggcgaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgt

SEQ ID NO: 1114 - DNA, 1452 bp, Lactobacillus rogosae
tcaggatgaacgctggcggcgtgcttaacacatgcagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgctccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaacgtaagaagagccgccgaagcaggtctgataactggg

SEQ ID NO: 1115 - DNA, 1561 bp, Lactobacillus ruminis
ttgagagtttgatcctggctcaggacgaacgctggcggcgtgcctaatacatgcaagtcgaacgaagctttctttcaccgaatgcttgcattcaccgaaagaagcttagtggcgaacgggtgagtaacacgtaggcaacctgcccaaaagagggggataacacttggaaacaggtgctaataccgcataaccatgaacaccgcatgatgttcatgtaaaagacggcttttgctgtcacttttggatgggcctgcggcgtattaacttgttggtggggtaacggcctaccaaggtgatgatacgtagccgaactgagaggttgatcggccacattgggactgagacacggcccaaactcctacgggaggcagcagtagggaatcttccacaatggacgaaagtctgatggagcaacgccgcgtgaatgaagaaggccttcgggtcgtaaaattctgttgtcagagaagaacgtgcgtgagagtaactgttcacgtattgacggtatctgaccagaaagccacggctaactacgtgccagcagccgcggtaatacgtaggtggcgagcgttgtccggatttattgggcgtaaagggaacgcaggcggtcttttaagtctgatgtgaaagccttcggcttaaccgaagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcttctgacaattccagagatggaacgttcccttcggggacagaatgacaggtggtgcatggttgtcgtcagctcgtgtcgtgagatgttgggttaagtcccgcaacgagcgcaacccttattgtcagttgccatcattaagttgggcactctggcgagactgccggtgacaaaccggaggaaggtggggatgacgtcaaatcatcatgccccttatgacctgggctacacacgtgctacaatggacggtacaacgagtcgctaactcgcgagggcaagctaatctcttaaagccgttctcagttcggattgcaggctgcaactcgcctgcatgaagtcggaatcgctagtaatcgcgaatcagcatgtcgcggtgaatacgttcccgggccttgtacacaccgcccgtcacaccatgagagtttgtaacacccaaagtcggtggggtaaccttttggagccagccgcctaaggtgggacagatgattggggtgaagtcgtaacaaggtagccgtaggagaacctgcggctggatcacctcctttct

SEQ ID NO: 1116 - DNA, 1579 bp, Lactobacillus sakei
gggaattcgattgagtttgatcctggctcaggacgaacgctggcggcgtgcctaatacatgcaagtcgaacgcactctcgtttagattgaaggagcttgctcctgattgataaacatttgagtgagtggcggacgggtgagtaacacgtgggtaacctgccctaaagtgggggataacatttggaaacagatgctaataccgcataaaacctaacaccgcatggtgtagggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaatgtatctgatagtaactgaccaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcggggagccagccgtctaaggtgggacagatgattagggtgaagtcgtaacaaggtagccgtaggagaacctgcggctggatcacctcctttct

SEQ ID NO: 1117 - DNA, 1566 bp, Lactobacillus salivarius
tttaaaatgagagtttgatcctggctcaggacgaacgctggcggcgtgcctaatacatgcaagtcgaacgaaactttcttacaccgaatgcttgcattcaccgtaagaagttgagtggcggacgggtgagtaacacgtgggtaacctgcctaaaagaaggggataacacttggaaacaggtgctaataccgtatatctctaaggatcgcatgattcttagatgaaagatggttctgctatcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattcgatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggctttcccttcggggacaaagtgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggacggtacaacgagtcgcgagaccgcgaggtttagctaatctcttaaagccgttctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccgcaaggagccagccgtctaaggtgggacagatgattggggtgaagtcgtaacaaggtagccgtaggagaacctgcggctggatcacctcctttct

SEQ ID NO: 1118 - DNA, 1558 bp, Lactobacillus saniviri
gatcatggctcaggatgaacgctggcggcgtgcctaatacatgcaagtcgaacgagttctggttaatgatggcggtgcttgcaccaatagatttaacatttgaacgagtggcggacgggtgagtaacacgtgggtaacctgccctaaagtgggggataacatttggaaacagatgctaataccgcataaatcttggaacctcatggttccaagctgaaagatggcgtaagctatcgcttttggatggacccgcggcgtattagctagttggtgaggtaaaggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacgtacgtgagagtaactgttcacgtagtgacggtatccaaccagaaagccacggctaactacgtgccagcagccgcggtaatacgtaggtggcaagcgttatccggatttattgggcgtaaagcgagcgcaggcggtttcttaagtctgatgtgaaagccctcggctcaaccgaggaagtgcatcggaaactgggaaacttgagtgcagaagaggacagtggaactccatgtgtagcggtggaatgcgtagatatatggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgctattctaagagattagaagttcccttcggggacagaatgacaggtggtgcatggttgtcgtcagctcgtgtcgtgagatgttgggttaagtcccgcaacgagcgcaacccttatgactagttgccagcattaagttgggcactctaatcagactgccggtgacaaaccggaggaaggtggggatgacgtcaaatcatcatgccccttatgacctgggctacacacgtgctacaatggatggtacaacgagtcgcaaaaccgcgaggttaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctccta

SEQ ID NO: 1119 - DNA, 1562 bp, Lactobacillus senioris
gagtttgatcatggctcaggacgaacgctggcggcgtgcctaatacatgcaagtcgaacgcgtcttggtgaatgatcggcggtgcttgcaccaaagagatttcacaatgagacgagtggcgaactggtgagtaacacgtggggaacctgcccataagcaggggataacacttggaaacaggtgctaataccgtataacaatgtaaaccgcatggtttacatttgaaagatggtttcggctatcacttatggatggacccgcggcgcattagctagttggtgaggtaacggctcaccaaggcaatgatgcgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttggagaagaacatggatgagagtaactgttcatttattgacggtatccaaccagaaagccacggctaactacgtgccagcagccgcggtaatacgtaggtggcaagcgttgtccggatttattgggcgtaaagcgagcgcaggcggtcttttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgcaacgcgaagaaccttaccaggtcttgacatcttctgctaacccaagagattgggcgttcccttcggggacggaatgacaggtggtgcatggctgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaagtcctcatgccccttatgacctgggctacacacgtgctacaatggacggtacaacgagtcgcgaaaccgcgaggtcaagctaatctcttaaagccgttctcagttcggattgcaggctgcaactcgcctgcatgaagtcggaatcgctagtaatcgtggatcagcatgccacggtgaatacgttcccgggccttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctcacctccta

SEQ ID NO: 1120 - DNA, 1617 bp, Lactobacillus sp. 66c
gagttccactctcctcttctgcactcaagaatgacagtttccgatgcagttccacggttgagccgtgggctttcacatcagacttatcattccgcctgcgctcgctttacgcccaataaatccggacaacgcttgccacctacgtagagtttgatcatggctcaggacgaacgctgggcggcgtgcctaatacatgcaagtcgagcgagctgaattcacagatcccttcggagtgacgtgttggacgctagcggcggatgggtgagtaacacgtgggcaatctgccctaaagactgggataccacttggaaacaggtgctaataccggataacaatgatggttgcatgaccattatttgaaaggcggcgcaagctgtcactttaggatgagcccgcggtgcattagctagttggtgaggtaacggctcaccaaggccatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatgtgagtagcaactggctcatatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgagaccgttatagagatataattttcccttcggggactcagagacaggtggtgcatggctgtcgtcagctcgtgtcgtgagatgttgggttaagtcccgcaacgagcgcaacccttgtctttagttgccagcattaagttgggcactctagagagactgccggtgacaaaccggaggaaggtggggatgacgtcaagtcatcatgccccttatgacctgggctacacacgtgctacaatgggcagtacaacgagaagcgaacctgcgaaggcaagcggatctcttaaagctgttctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgggataacccttttggaa

SEQ ID NO: 1121 - DNA, 1409 bp, Lactobacillus sp. BT6
  modified_base (8)..(8): a, c, t, g, unknown or other
  modified_base (14)..(14): a, c, t, g, unknown or other
  modified_base (40)..(40): a, c, t, g, unknown or other
tgattatntgaaanggtgcttgcatcttgatttaattttngaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatactaggtggcaagcgttatccggatttattgggcgtaaagcgagcgcaggcggttttttaagtctgatgtgaaagccctcggcttaaccgaggaagtgcatcggaaactggaaacttgagtgcagaagaggacagtggaactccatgtgtagcggtgaaatgcgtagatatatggaagaacaccagtggcgaaggcggctgtctggtctgtaactgacgctgagctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttaggg

SEQ ID NO: 1122 - DNA, 1238 bp, Lactobacillus sp. KLDS 1.0701
agcggcggatgggtgagtaacacgtggggaacctgccccatagtctgggataccacttggaaacaggtgctaataccggataagaaaagtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgtcattagttgccagcatgggcactctaatgagactgccggtgacaaaccggaggaaggtggggatgacgtcaagtcatcatgccccttatgacctgggctacacacgtgctacaatggacagcaacgaggagcaagcctgcgaaggcaagcgaatctcttctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagg

SEQ ID NO: 1123 - DNA, 1237 bp, Lactobacillus sp. KLDS 1.0702
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgg

SEQ ID NO: 1124 - DNA, 1236 bp, Lactobacillus sp. KLDS 1.0703
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtg

SEQ ID NO: 1125 - DNA, 1264 bp, Lactobacillus sp. KLDS 1.0704
gcggcgtgctatacatgcagtcgaacgagtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgg

SEQ ID NO: 1126 - DNA, 1240 bp, Lactobacillus sp. KLDS 1.0705
agtggcgaactggtgagtaacacgtgggaaacctgcccagaagcgggggataacacctggaaacagatgctaataccgcataacgaaagtcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagatgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgactgacgctgaggctcgaaagtatgggtagcaaacaggattagataccctggtagtccataccgtaaacgatgaatgctaagtgttggagcttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatatacaggtggtgcatggttgtcgtcagctcgtgtcgtgagatgttgggttaagtcccgcaacgagcgcaacccttattatcagttgccagcatgggcactctggtgagactgccggtgacaaaccggaggaaggtggggatgacgtcaaatcatcatgccccttatgacctgggctacacacgtgctacaatggatggcaacgagttgcgaactcgcgagagtaagctaatctcttccattctcagttcggatgtaggctgcaactcgcctacagaagtcggaatcgctagtaatcgcggatcagcatgccgcggtgaatacgttcccgggccttgtacacaccgcccgtcacaccatgagagtttgtaacacccaaagtcggtgggtaaccagccgcctaaggtgggac

SEQ ID NO: 1127 - DNA, 1236 bp, Lactobacillus sp. KLDS 1.0707
agtggcggacgggtgagtaacacgtaggtaacctgcccagaagcgggggacaacatttggaaacagatgctaataccgcataacaaaagtcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtg

SEQ ID NO: 1128 - DNA, 1237 bp, Lactobacillus sp. KLDS 1.0709
agtggcggacgggtgagtaacacgtaggtaacctgcccagaagcgggggacaacatttggaaacagatgctaataccgcataacaaaagtcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgg

SEQ ID NO: 1129 - DNA, 1236 bp, Lactobacillus sp. KLDS 1.0711
agtggcggacgggtgagtaacacgtaggtaacctgcccagaagcgggggacaacatttggaaacagatgctaataccgcataacaaaagtcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtg

SEQ ID NO: 1130 - DNA, 1238 bp, Lactobacillus sp. KLDS 1.0712
agcggcggatgggtgagtaacacgtggggaacctgccccatagtctgggataccacttggaaacaggtgctaataccggataagaaaagtcgctatgggatggccccgcggtgcattagctagttggtaaggtaaaggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttattagttgccagcatgggcactctaatgagactgccggtgacaaaccggaggaaggtggggatgacgtcaagtcatcatgccccttatgacctgggctacacacgtgctacaatgggcagcaacgagaagcgagcctgcgaaggcaagcgaatctctgctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagg

SEQ ID NO: 1131 - DNA, 1237 bp, Lactobacillus sp. KLDS 1.0713
agtggcggacgggtgagtaacacgtaggtaacctgcccagaagcgggggacaacatttggaaacagatgctaataccgcataacaaaagtcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagatgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgactgacgctgagactcgaaagcatgggtagcgaacaggattagataccctggtagtccatgccgtaaacgatgagtgctaggtgttggagcttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagcaaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgtaacacccaaagtcggtgggtagccagccgcctaaggtgg

SEQ ID NO: 1132 - DNA, 1237 bp, Lactobacillus sp. KLDS 1.0716
agtggcggacgggtgagtaacacgtaggtaacctgccccaaagcgggggataacatttggaaacagatgctaataccgcataacaaaagtcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagatgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgactgacgctgaggctcgaaagcatgggtagcgaacaggattagataccctggtagtccatgccgtaaacgatgagtgctaggtgttggagcttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagctaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgcaacacccaaagtcggtgggtagctagccgcctaaggtgg

SEQ ID NO: 1133 - DNA, 1252 bp, Lactobacillus sp. KLDS 1.0718
atacatgcaagtcgaacgagtggcggacgggtgagtaacacgtaggtaacctgccccaaagcgggggataacatttggaaacagatgctaataccgcataacaaaagtcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttagagaagatgacggtatctaaccagaaagtcacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaagaacaccagtggcgaaggcggctgtctggtctgactgacgctgaggctcgaaagcatgggtagcgaacaggattagataccctggtagtccatgccgtaaacgatgagtgctaggtgttggagcttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcgacaggtggtgcatggtcgtcgtcagctcgtgtcgtgagatgttgggttaagtcccgcaacgagcgcaacccttgttactagttgccagcatgggcactctagtgagactgccggtgacaaaccggaggaaggtggggacgacgtcagatcatcatgccccttatgacctgggctacacacgtgctacaatggacggcaacgagtcgcgaactcgcgagggcaagctaatctcttccgttctcagttcggatgcaggctgcaactcgcctgcagaagtcggaatcgctagtaatcgcggatcagcatgccgcggtgaatacgttcccgggccttgtacacaccgcccgtcacaccatgagagtttgcaacacccaaagtcggtgggtagctagccgcctaagg

SEQ ID NO: 1134 - DNA, 1237 bp, Lactobacillus sp. KLDS 1.0719
agtggcggacgggtgagtaacacgtgggtaacctgcctaaaagaaggggataacacttggaaacaggtgctaataccgtatatcgaaagtcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgactgacgctgaggttcgaaagcgtgggtagcaaacaggattagataccctggtagtccacgccgtaaacgatgaatgctaggtgttggagcttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttgtcagttgccagcatgggcactctggcgagactgccggtgacaaaccggaggaaggtggggacgacgtcaagtcatcatgccccttatgacctgggctacacacgtgctacaatggacggcaacgagtcgcaagaccgcgaggtttagctaatctcttccgttctcagttcggatgtaggctgcaactcgcctacagaagtcggaatcgctagtaatcgcgaatcagcatgtcgcggtgaatacgttcccgggccttgtacacaccgcccgtcacaccatgagagtttgtaacacccaaagccggtgggtagccagccgtctaaggtgg

SEQ ID NO: 1135 - DNA, 1364 bp, Lactobacillus sp. oral clone HT002
gagtttgattctggctcaggatgaacgccggcggtgtgcctaatacatgcaagtcgaacgagtggcggacgggtgagtaacacgtaggtaacctgcccggaagcgggggacaacatttggaaacagatgctaataccgcataacaaaagtcacttctggatggacctgcggtgcattagcttgttggtggggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagatgacggtatccaaccagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatcgacaggtggtgcatggctgtcgtcagctcgtgtcgtgagatgttgggttaagtcccgcaacgagcgcaacccttgtcattagttgccatcatgggcactataatgagactgccggtgacaaaccggaggaaggtggggatgacgtcaagtcatcatgccccttatgacctgggctacacacgtgctacaatggacggcaacgagaagcgaacctgcgaaggcaagcggatctctgccgttctcagttcggatgtaggctgcaactcgcctacagaagctggaatcgctagtaatcgcggatcagcacgccgcggtgaatacgttcccgggccttgtacacaccgcccgtcacaccatgagagtctgtaacacccaaagccggtggatagtcagccgtctaaggtaggacagatgattagggtgaagtcgtaacaaggtagccgtaggagaacctgcggctggatcacctcctt

SEQ ID NO: 1136 - DNA, 1361 bp, Lactobacillus sp. oral clone HT070
gagtttgattctggctcaggacgaacgctggcggcgtgcctaatacatgcaagtcgagcgagcggcggatgggtgagtaacacgtggggaacctgccccagagtctgggataccacttggaaacaggtgctaataccggataagaaaagtcgctcagggatggccccgcggtgcattagctagttggcaaggtaacggcctaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagatgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaattgcatcggaaactgtttttcttgagtgcagaagaggagagtggaactccatgtgtagcggtggaatgcgtagatatatggaagaacaccagtggcgaaggcggctctctggtctgactgacgctgaggctcgaaagcatgggtagcgaacaggattagataccctggtagtccatgccgtaaacgatgagtgctaagtgttgggatctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggctgtcgtcagctcgtgtcgtgagatgttgggttaagtcccgcaacgagcgcaacccttgttattagttgccagcatgggcactctaatgagactgccggtgacaaaccggaggaaggtggggatgacgtcaagtcatcatgccccttatgacctgggctacacacgtgctacaatggacagcaacgagcagcgagcctgcgaaggcaagcgaatctctgctgttctcagttcggatgcagtctgcaactcgactgcagaagctggaatcgctagtaatcgcggatcagcacgccgcggtgaatacgttcccgggccttgtacacaccgcccgtcacaccatgggagtctgcaatgcccaaagccggtgcctaaggagccgtctaaggcagggcagatgactggggtgaagtcgtacaaggtagccgtaggaaacctgcggctggacacctcctt

SEQ ID NO: 1137 - DNA, 994 bp, Lactobacillus sp. oral taxon 052
  modified_base (43)..(43): a, c, t, g, unknown or other
  modified_base (45)..(45): a, c, t, g, unknown or other
  modified_base (633)..(633): a, c, t, g, unknown or other
  modified_base (635)..(635): a, c, t, g, unknown or other
  modified_base (637)..(637): a, c, t, g, unknown or other
  modified_base (727)..(727): a, c, t, g, unknown or other
  modified_base (876)..(876): a, c, t, g, unknown or other
  modified_base (944)..(945): a, c, t, g, unknown or other
  modified_base (978)..(978): a, c, t, g, unknown or other
  modified_base (984)..(986): a, c, t, g, unknown or other
cgcactggcccaactgagatgacgtgcttgcactgatttgacnanggattaccagtgagtggcggacgggtgagtaacacgtaggcaacctgcccaagagcgggggataacatttggaaacaagtgctaataccgcataagattgatgaccacatggtcatcaatttaaagatggcttcggctatcactcttggatgggcctgcggtgcattagctagttggtaaggtaacggcttaccaaggcagtgatgcatagccgagttgagagactgatcggccacaatgggactgagacacggcccatactcctacgggaggcagcagtagggaatcttccacaatgggcgcaagcctgatggagcgacaccgcgtgagtgaagaagggtttcggctcgtaaagctctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccgaagaagggcatcggaaactggatgacttgagtgcagaagangncngtggaactccatgtgtagcggtggaatgcgtagatatatggaagaacaccagtggcgaaggcggctgcctagtctgcaactgacgctgangctcgaaagcatgggtagcgaacaggattagataccctggtagtccatgccgtaaacgatgagtgctaggtgttggagggtttccgcccttcagtgccgcagctaacgcaataagcactccgcctggggagtacgaccgcaaggttganctcaaaggaattgacgggggcccgcacaagcggtggagcatgtggtttaattcgaagctacgcgagannttaccaggtcttgacatcttgcgctaacctaanagattnnngttccctt

SEQ ID NO: 1138 - DNA, 1557 bp, Lactobacillus tucceti
  modified_base (1548)..(1548): a, c, t, g, unknown or other
ttaagagtttgatttaggctcaggacgaacgctggcggcgtgcctaatacatgcaagtcgagcgaactctggtaactgaacgatgggtgcttgcaccggagtgatgatacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaagtctaagagattagaggttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagancctgcggct

SEQ ID NO: 1139 - DNA, 1561 bp, Lactobacillus ultunensis
tgagagtttgatcctggctcaggacgaacgctggcggcgtgcctaatacatgcaagtcgagcgagcggaaccagcagatctgcttcggcagtgacgctgggaaagcgagcggcggatgggtgagtaacacgtggggaacctgccccaaagtctgggataccacttggaaacaggtgctaataccggataagaaagcagatcgcatgatcagcttttaaaaggcggcgtaagctgtcgctatgggatggccccgcggtgcattagctagttggtagagtaacggcctaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcttcagagatgaagagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaacgcccaaagccggtggcctaaccgaaaggaaggagccgtctaaggcagggcagatgactggggtgaagtcgtaacaaggtagccgtaggagaacctgcggctggatcacctcctttct

SEQ ID NO: 1140 - DNA, 1410 bp, Lactobacillus vaginalis
gggggataacatctggaaacaggtgctaataccgcataacaacgaaaaccacatggttttcgtttcaaagatggtttcggctatcacttcaggatgggcccgcggtgcattagctagttggtaaggtaacggcttaccaaggcaatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagggcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagttgcgaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtggcctaaccatttggagggaaccgcctaaggcagggcagatgactggggtgaagtcgtaacaaggtagccgtaggagaacctgcggctggatcacctcctttct

SEQ ID NO: 1141 - DNA, 1503 bp, Lactobacillus vini
agagtttgattatggctcaggacgaacgctggcggcgtgcctaatacatgcaagtcgaacgagactttttatttgatgcttgcatcttttaaaaagttgagtggcgaacgggtgagtaacacgtgggtaacctgccttaaagtgggggataacacttggaaacaggtgctaataccgcataaccatcaaaaccgcctggttttgatgttaaagatggttctgctatcgctttaagatggacccgcggcgtattagctagttggtgaggtaacggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgtcagagaagaacgtgtgtgagagtaactgttcacgcagtgacggtatctgaccagaaagtcacggctaactacgtgccagcagccgcggtaatacgtaggtggcaagcgttgtccggatttattgggcgtaaagggaacgcaggcggtcttttaagtctgatgtgaaagccttcggcttaaccgaagtcgggcattggaaactgggagacttgagtgcagaagaagagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgccgcagctaacgcattaagcattccgcctggggagtacgatcgcaagattgaaactcaaaggaattgacgggggcccgcacaagcggtggagcatgtggtttaattcgaagcaacgcgaagaaccttaccaggtcttgacatcttttgctaacctgagagatcaggtgttcccttcggggacaaaatgacaggtggtgcatggttgtcgtcagctcgtgtcgtgagatgttgggttaagtcccgcaacgagcgcaacccttattgttagttgccagcatttagttgggcactctaacgagactgccggtgacaaaccggaggaaggtggggatgacgtcaaatcatcatgccccttatgacctgggctacacacgtgctacaatggacggtacaacgagtcgcaagaccgcgaggtcaagctaatctctgaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggggtaacctttgggagccagccgtctaaggtgggacagatgattggggtgaaga

SEQ ID NO: 1142 - DNA, 1450 bp, Lactobacillus vitulinus
gatgaacgctggcggcgtgcctaatacatgcaagtcgaacgggaatcttcggattccagtggcgaacgggtgaggaatacataggtaacctgcccctccgagggggacaacagacggaaacatctgctaagaccgcatagccacagggaaggcatcttccctgtgccaaatgtcctttcggggacagcggggggatggacctatgccgcattagctggttggcggggcaacggcccaccaaggcgacgatgcgtagccggcctgagagggcggacggccacactgggactgagacacggcccagactcctacgggaggcagcagtagggaattttcggcaatgggggaaaccctgaccgagcaacgccgcgtgaacgatgaaggccttcgggtcgtaaagttctgttgcgaaggaagaacgccggtgtcaggaaatgggcgccgggtgacggtacttcgcatagaaagccacggctaactacgtgccagcagccgcggtaatacgtaggtggcgagcgttatccggaatcattgggcgtaaagagggagcaggcggcgatacaggtctgtggtgaaattccgaagctaaacttcggccagccaaagaaaccggatcgctagagtgcggaagaggatcgtggaattccatgtgtagcggtgaaatgcgtagatatatggaggaacaccagtggcgaaggcgacggtctgggccgcaactgacgctcattcccgaaagcgtggggagcaaataggattagataccctagtagtccacgccgtaaacgatcgatactaagtgtcgggggtcaaacctcggtgctggagtcaacgcaataagtatcgcgcctgagtagtacgttcgcaagaatgaaactcaaaggaattgacgggggcccgcacaagcggtggagcatgtggtttaattcgaagcaacgcgaagaaccttaccaggtcttgacatcgatccaaaagggacggaaacgtccccatagctatggagaagacaggtggtgcatggtgtcgtcagctcgtgtcgtgagatgttgggttaagtcccgcaacgagcgcaacccctgtcgccagttgccagcattgagttggggactctggcgagactgcctctgcaaggaggaggaaggcggggatgacgtcaaatcatcatgccccttatgacctgggccacacacgtgctacaatggacggagcagagggaagcgaagcggcgacgccaagcggatcccagaaacccgttctcagttcggactgcagtctgcaactcgactgcacgaagctggaatcgctagtaatcgcggatcagcatgccgcggtgaatacgttctcgggccttgtacacaccgcccgtcacaccatgagagtcggcaacacccgaagccggtggctcaacccttctgggagggagctgtctaaggtggggccgatgattggggtg

SEQ ID NO: 1143 - DNA, 1419 bp, Lactobacillus zeae
cgagttttggtcgatgaacggtgcttgcatcgtgattcaacttaaaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgagctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacgtcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagc

SEQ ID NO: 1144 - DNA, 1485 bp, Lactococcus garvieae
aacgctggcggcgtgcctaatacatgcaagtcgagcgatgattaaagatagcttgctatttttatgaagagcggcgaacgggtgagtaacgcgtgggaaatctgccgagtagcgggggacaacgtttggaaacgaacgctaataccgcataacaatgagaatcgcatgattcttatttaaaagaagcaattgcttcactacttgatgatcccgcgttgtattagctagttggtagtgtaaaggactaccaaggcgatgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaaactctgttgttagagaagaacgttaagtagagtggaaaattacttaagtgacggtatctaaccagaaagggacggctaactacgtgccagcagccgcggtaatacgtaggtcccaagcgttgtccggatttattgggcgtaaagcgagcgcaggtggtttcttaagtctgatgtaaaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagctgtagggagctataagttctctgtagcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctatccttagagataaggagttccttcgggacacgggatacaggtggtgcatggttgtcgtcagctcgtgtcgtgagatgttgggttaagtcccgcaacgagcgcaacccttattactagttgccatcattaagttgggcactctagtgagactgccggtgataaaccggaggaaggtggggatgacgtcaaatcatcatgccccttatgacctgggctacacacgtgctacaatggatggtacaacgagtcgccaacccgcgagggtgcgctaatctcttaaaaccattctcagttcggattgcaggctgcaactcgcctgcatgaagtcggaatcgctagtaatcgcggatcagcacgccgcggtgaatacgttcccgggccttgtacacaccgcccgtcacaccacggaagttgggagtacccaaagtaggttgcctaaccgcaaggagggcgcttcctaaggtaagaccgatgactggggtgaagtcgtaacaaggtagc

SEQ ID NO: 1145 - DNA, 1554 bp, Lactococcus lactis
ctttatttgagagtttgatcctggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctttctaag

SEQ ID NO: 1146 - DNA, 1440 bp, Lactococcus raffinolactis
agttgaacgcttgattttcaccgaagcttgcttcaccgaaaatcaagagtagcgaacgggtgagtaacgcgtgggtaacctacctatcagcgggggataactattggaaacgatagctaataccgcataacaatgttggatgcatattcgacatttgaaagtaccaaatggtacactgagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgttgcatagagtggaaaattatgcaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaaggcagtgatgtcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgat

SEQ ID NO: 1147 - DNA, 1281 bp, Lactonifactor longoviformis
gagtttgattatggctcaggatgaacgctggcggcgtgcttaacacatgcaagtcgaacgagtggcggacgggtgagtaacgcgtggataacctgcctcatacagggggataacagttagaaatgactgctaataccgcataagaaaaggcggtatgagatggatccgcgtttgattagctagttggtggggtaaaggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgaactgacgttgaggctcgaaagcgtggggagcaaacaggattagataccctggtagtccacgccgtaaacgatgaatactaggtgtcgggcgttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccttatccttagtagccagcagctgggcactctagggagactgccagggacaacctggaggaaggtggggatgacgtcaaatcatcatgccccttatgatttgggctacacacgtgctacaatggcgtacaaagggaagcgaaggggtgacctgaagcaaatcccaaaacgtctcagttcggatgtagtctgcaactcgactacagaagctggaatcgctagtaatcgcgaatcagaatgtcgcggtgaatacgttcccgggtcttgtacacaccgcccgtcacaccatgggagtcggatatgcccgaagccggtaccga

SEQ ID NO: 1148 - DNA, 1544 bp, Laribacter hongkongensis
tgaacgaaagagtttgatcctggctcagattgaacgctggcggcatgctttacacatgcaagtcgaacggtaacagggacttcggtctgctgacgagtggcgaacgggtgagtaatgcatcggaacgtaccgagtaatgggggataacgcatcgaaaggtgtgctaataccgcatacgccctgagggggaaagcgggggatcgaaagacctcgcgttattcgagcggccgatgccggattagctagttggtggggtaaaggctcaccaaggcgacgatccgtagcaggtctgagaggatgatctgccacactgggactgagacacggcccagactcctacgggaggcagcagtggggaattttggacaatgggggcaaccctgatccagccatgccgcgtgtctgaagaaggccttcgggttgtaaaggacttttgtcagggaggaaatccttaaggctaatacccttgggggatgacagtacctgaagaataagcaccggctaactacgtgccagcagccgcggtaatacgtagggtgcaagcgttaatcggaattactgggcgtaaagcgtgcgcaggcggtttgaaaagtcagctgtgaaagccccgggctcaacctgggaactgcggttgaaactctcaagctagagtgcgtcagaggggggtggaattccacgtgtagcagtgaaatgcgtagagatgtggaggaacaccaatggcgaaggcagccccctgggatgacactgacgctcatgcacgaaagcgtggggagcaaacaggattagataacctggtagtccacgccctaaacgatgtcgactagccgttggagatttcggtttctggtggcgcagctaacgcgtgaagtcgaccgcctggggagtacggtcgcaagattaaaactcaaaggaattgacgggggcccgcacaagcggtggatgatgtggattaattcgatgcaacgcgaaaaaccttacctggtcttgacatgtaccgaacctcgaagagatttgagggtgcccgaaagggagcggtaacacaggtgctgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcctcatggcccttatgaccagggcttcacacgtcatacaatggtcggtacagagggtcgctaagccgcgaggtagtgccaatctcataaaaccgatcgtagtccggatcgcagtctgcaactcgactgcgtgaagtcggaatcgctagtaatcgcggatcagcatgtcgcggtgaatacgttcccgggccttgtacacaccgcccgtcacaccatgggagtggaatccgccagaagtgggtagggtaaccgtaaggagcccgcttaccacggtaggtttcatgactggggtgaagtcgtaacaaggtagccgtaggggaacctgcggctggatcacctcctttctagaga

SEQ ID NO: 1149 - DNA, 1534 bp, Lautropia mirabilis
ttgaactgaagagtttgatcctggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggatcttcggacctcgcgctattggagcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcaagcgttaatcggaattactgggcgtaaagagtgcgcaggcggttttgcaagaccgatgtgaaatccccgggcttaacctgggaactgcattggtgactgcaaggctagagtgtgtcagagggaggtggaattccgcatgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccctgaagagatttgggggtgctcgaaagagagccggaacacaggtgctgcatggctgtcgtcagctcgtgtcgtgagatgttgggttaagtcccgcaacgagcgcaacccttatcattagttgctacgcaagggcactctaatgagactgccggtgacaaaccggaggaaggtggggatgacgtcaagtcctcatggcccttatgtgtagggcttcacacgtcatacaatggtcggtacagagggttgcgaagccgcgaggtggagccaatcccaaaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtgggttttaccagaagtaggtagcttaaccgcaaggagggcgcttaccacggtagggctcatgactggggtgaagtcgtaacaaggtagccgtaccggaaggtgcggctggatcacctcctttc

SEQ ID NO: 1150 - DNA, 1491 bp, Lautropia sp. oral clone AP009
agagtttgattatggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggatcttcggacctcgcgctattggagcggccgatggcagattagctggttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcgagcgttaatcggaattactgggcgtaaagagtgcgcaggcggttttgcaagaccgatgtgaaatccccgggcttaacctgggaactgcattggtgactgcaaggctagagtgtgtcagagggaggtggaactccgcatgtagcagtgaaatgcgtagatatgcggaagaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccttggagagattcgagggtgcccgaaagggaaccggaacacaggtgctgcatggctgtcgtcagctcgtgtcgtgagatgttgggttaagtcccgcaacgagcgcaacccttatcattagttgctacgcaagggcactctaatgagactgccggtgacaaacckgagkaaggtggggatgacgtcaagtcctcatggcccttatgtgtagggcttcacacgtcatacaatggtcggtacagagggttgccaagccgcgaggtggagccaatcccacaaaaccgatcgtagtccggattgcagtctgcaactcgactgcatgaagtcggaatcgctagtaatcgcggwtcagcatgccgcggtgaatacgttcccgggtcttgtacacaccgcccgtcacaccatgggagtgggttttaccagaagtaggtagcttaaccgcaaggggggcgcttaccacggtagggctcatgactggggtgaagtcgtaacaaggtaac

SEQ ID NO: 1151 - DNA, 1467 bp, Legionella hackeliae
  modified_base (8)..(8): a, c, t, g, unknown or other
  modified_base (23)..(24): a, c, t, g, unknown or other
  modified_base (31)..(31): a, c, t, g, unknown or other
  modified_base (42)..(42): a, c, t, g, unknown or other
  modified_base (70)..(71): a, c, t, g, unknown or other
  modified_base (74)..(74): a, c, t, g, unknown or other
  modified_base (82)..(82): a, c, t, g, unknown or other
  modified_base (112)..(112): a, c, t, g, unknown or other
  modified_base (149)..(149): a, c, t, g, unknown or other
  modified_base (158)..(158): a, c, t, g, unknown or other
  modified_base (164)..(164): a, c, t, g, unknown or other
  modified_base (174)..(174): a, c, t, g, unknown or other
  modified_base (210)..(210): a, c, t, g, unknown or other
  modified_base (216)..(216): a, c, t, g, unknown or other
  modified_base (243)..(243): a, c, t, g, unknown or other
  modified_base (359)..(359): a, c, t, g, unknown or other
  modified_base (414)..(414): a, c, t, g, unknown or other
  modified_base (420)..(420): a, c, t, g, unknown or other
  modified_base (447)..(447): a, c, t, g, unknown or other
  modified_base (466)..(466): a, c, t, g, unknown or other
  modified_base (471)..(471): a, c, t, g, unknown or other
  modified_base (502)..(502): a, c, t, g, unknown or other
  modified_base (525)..(525): a, c, t, g, unknown or other
  modified_base (546)..(546): a, c, t, g, unknown or other
  modified_base (565)..(565): a, c, t, g, unknown or other
  modified_base (583)..(584): a, c, t, g, unknown or other
  modified_base (592)..(592): a, c, t, g, unknown or other
  modified_base (596)..(596): a, c, t, g, unknown or other
  modified_base (613)..(613): a, c, t, g, unknown or other
  modified_base (625)..(625): a, c, t, g, unknown or other
  modified_base (629)..(629): a, c, t, g, unknown or other
  modified_base (632)..(632): a, c, t, g, unknown or other
  modified_base (646)..(646): a, c, t, g, unknown or other
  modified_base (686)..(686): a, c, t, g, unknown or other
  modified_base (734)..(734): a, c, t, g, unknown or other
  modified_base (739)..(739): a, c, t, g, unknown or other
  modified_base (833)..(833): a, c, t, g, unknown or other
  modified_base (879)..(879): a, c, t, g, unknown or other
  modified_base (938)..(938): a, c, t, g, unknown or other
  modified_base (950)..(952): a, c, t, g, unknown or other
  modified_base (961)..(961): a, c, t, g, unknown or other
  modified_base (976)..(976): a, c, t, g, unknown or other
  modified_base (986)..(986): a, c, t, g, unknown or other
  modified_base (1085)..(1085): a, c, t, g, unknown or other
  modified_base (1110)..(1110): a, c, t, g, unknown or other
  modified_base (1205)..(1205): a, c, t, g, unknown or other
  modified_base (1268)..(1268): a, c, t, g, unknown or other
  modified_base (1280)..(1280): a, c, t, g, unknown or other
  modified_base (1288)..(1288): a, c, t, g, unknown or other
  modified_base (1294)..(1294): a, c, t, g, unknown or other
  modified_base (1344)..(1344): a, c, t, g, unknown or other
agagtttnatcctggctcagatnnaacgctngcggcatgctnaacacatgcaagtcgaacggcagcatgnnctngctggctnggaagatggcgagtggcgaacgggtgagtnacgcgtaggaatrtgccttaaagagggggacaacctngggaaactnaggctnataccgcatnatttctgaggaaaaaagctggggaccgcaaggcctngcgctnaaagattagcctgcgtccgattagctngttggtggggtaagggcctaccaaggcgacgatcggtagctggtctgagaggatgatcagccacactgggactgagacacggcccagactcctacgggaggcagcagtggggaatnttggacaatggggggaaccctratccagcaatgccgcgtgtgtgaagaaggcctnagggtngtaaagcactttcagtggggaggaganraggttaggttaagagctngactnaaggacgcacccacagaagaagcaccggctnactccgtgccagcagccgcggtnatacggagggtgcaagcgttnatcggaattactgggcgtnaagggtgcgtaggtggtnnaataagtnagtngtgaaatccctrggctnaacctgggaatngcanctnagactgttagactngagtataggagagggtagtggaatttccggtgtagcggtnaaatgcgtagagatcggaaggaacaccagtggcgaaggcggctacctngcctnatactgacactgaggcacgaaagcgtggggagcaaacaggattagataccctggtagtccacgctgtaaacgatgtcaactagctrttggtctnataaatgagattagtggcgcagcaaacgcgataagttgaccgcctngggagtacggtcgcaagatyaaaactcaaaggaattgacgggggcccgcacaagcggtngagcatgtggtnnnattcgatgnaacgcgaagaacctnacctaccctngacatacagtgaatgatgcagagatgcatyagtgccttcgggaacactgatacaggtgctgcatggctgtcgtcagctcgtgtcgtgagatgttgggtnaagtcccgtaacgagcgcaaccctngtccttagttgccagcgcgtagaggcgggaactctagggagactgccggtgacaaaccggaggaaggcggggatgacgtcaagtcatcatrgccnttacgggtagggctacacacgtgctacaatggccggtacagagggaagcgaaggggcgacctngagcaaatcctnaaaagctngtcgtngtccggattggagtctgcaactcgactccatgaagtcggaatcgctagtnatcgcgaatcagcatgtcgcggtgaatacgttcccgggccttgtacacaccgcccgtcacaccatgggagtgggttgcaccagaagtagatagtctaaccttcggggggacgtrtaccacggt

SEQ ID NO: 1152 - DNA, 1473 bp, Legionella longbeachae
  modified_base (13)..(14): a, c, t, g, unknown or other
  modified_base (29)..(30): a, c, t, g, unknown or other
  modified_base (37)..(37): a, c, t, g, unknown or other
  modified_base (48)..(48): a, c, t, g, unknown or other
  modified_base (84)..(84): a, c, t, g, unknown or other
  modified_base (88)..(88): a, c, t, g, unknown or other
  modified_base (92)..(92): a, c, t, g, unknown or other
  modified_base (137)..(137): a, c, t, g, unknown or other
  modified_base (164)..(164): a, c, t, g, unknown or other
  modified_base (170)..(170): a, c, t, g, unknown or other
  modified_base (177)..(177): a, c, t, g, unknown or other
  modified_base (216)..(216): a, c, t, g, unknown or other
  modified_base (222)..(222): a, c, t, g, unknown or other
  modified_base (236)..(236): a, c, t, g, unknown or other
  modified_base (249)..(249): a, c, t, g, unknown or other
  modified_base (365)..(365): a, c, t, g, unknown or other
  modified_base (420)..(420): a, c, t, g, unknown or other
  modified_base (464)..(464): a, c, t, g, unknown or other
  modified_base (471)..(471): a, c, t, g, unknown or other
  modified_base (478)..(479): a, c, t, g, unknown or other
  modified_base (508)..(508): a, c, t, g, unknown or other
  modified_base (552)..(552): a, c, t, g, unknown or other
  modified_base (571)..(571): a, c, t, g, unknown or other
  modified_base (590)..(590): a, c, t, g, unknown or other
  modified_base (598)..(598): a, c, t, g, unknown or other
  modified_base (619)..(619): a, c, t, g, unknown or other
  modified_base (740)..(740): a, c, t, g, unknown or other
  modified_base (745)..(745): a, c, t, g, unknown or other
  modified_base (765)..(765): a, c, t, g, unknown or other
  modified_base (846)..(846): a, c, t, g, unknown or other
  modified_base (885)..(885): a, c, t, g, unknown or other
  modified_base (906)..(906): a, c, t, g, unknown or other
  modified_base (944)..(944): a, c, t, g, unknown or other
  modified_base (956)..(958): a, c, t, g, unknown or other
  modified_base (982)..(982): a, c, t, g, unknown or other
  modified_base (992)..(992): a, c, t, g, unknown or other
  modified_base (1091)..(1091): a, c, t, g, unknown or other
  modified_base (1116)..(1116): a, c, t, g, unknown or other
  modified_base (1211)..(1211): a, c, t, g, unknown or other
  modified_base (1274)..(1274): a, c, t, g, unknown or other
  modified_base (1300)..(1300): a, c, t, g, unknown or other
  modified_base (1374)..(1374): a, c, t, g, unknown or other
aactgaagagttnnatcctggctcagatnnaacgctngcggcatgctnaacacatgcaagtcgaacggcagcatgacctagctngctnggtngatggcgagtgccgaacgggtgagtaacgcgtaggaatrtgcctnaaagactgggataacttggggaaactnaagctnataccgnatgatgtctgaggacgaaagctggggaccttcgggcctngcgctnaaagattagcctgngtccgatyagctngttggtggggtaagggcctaccaaggcgacgatcggtagctggtctgagaggatgaccagccacactggaactgagacacggtccaggctcctacgggaggcagcagtggggaatnttggacaatgggggcaaccctratccagcaatgccgcgtgtgtgaagaaggcctnagggtygtaaagcactttcagtggggaggagggtygataggtgnagagctnatggatnngacgttacccacagaagaagcaccggctnactccgtgccagcagccgcggtaatacggagggtgctagcgttnatcggaattactgggcgtnaagcgtgcgtaggtggttnattaagtnatctgtgaaatccctrggctnaacctgggcaggtcagatgatactggttgactcgagtatgggagagggtagtggaatttccggtgtagcggtgaaatgcgtagagatcggaaggaacaccagtggcgaaggcggctacctngcctnatactgacactgaggcacgnaagcgtggggagcaaacaggattagataccctggtagtccacgccgtaaacgatgtcaactagctrttggatatatgaatntrtttagtggcgcagcaaacgcgataagtwgaccgcctngggagtacggtcgcaagayynaaactcaaaggaattgacgggggcccgcacaagcggtngagcatgtggtnnnattcgatgcaacgcgaagaacctnacctaccctngacatacagtgaatgatgcagagatgcatyagtgccttcgggaacactgatacaggtgctgcatggctgtcgtcagctcgtgtcgtgagatgttgggtnaagtcccgtaacgagcgcaaccctngtccttagttgccagcacgtaaaggtgggaactctaaggagactgccggtgacaaaccggaggaaggcggggatgacgtcaagtcatcatrgccnttacgggtagggctacacacgtgctacaatggacgatacagagggaagcgaaggggtgacctngagccaatcttagaaagtygttcgtngtccggattggagtctgcaactcgactccatgaagtcggaatcgctagtaatcgcgaatcagcatgtcgcggtnaatacgttcccgggccttgtacacaccgcccgtcacaccatgggagtgggctgcaccagaagtagatagtctaaccttcggggggacgtgtaccacggt

SEQ ID NO: 1153 - DNA, 1546 bp, Legionella pneumophila
tgaactgaagagtttgatcctggctcagattgaacgctggcggcatgcttaacacatgcaagtcgaacggcagcattgtctagcttgctagacagatggcgagtggcgaacgggtgagtaacgcgtaggaatatgccttgaagagggggacaacttggggaaactcaagctaataccgcataatgtctgaggacgaaagctggggaccttcgggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgataggttaagagctgattaactggacgttacccacagaagaagcaccggctaactccgtgccagcagccgcggtaatacggagggtgcgagcgttaatcggaattactgggggtaaagggtgcgtaggtggttgattaagttatctgtgaaattcctgggcttaacctgggacggtcagataatactggttgactcgagtatgggagagggtagtggaatttccggtgtagcggtgaattgcgtagagatcggaaggaacaccagtggcgaaggcggctacctggcctaatactgacactgaggcacgaaagcgtggggagcaaacaggattagataccctggtagtccacgctgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttatccttagttgccagcatgtgatggtggggactctaaggagactgccggtgacaaaccggaggaaggcggggatgacgtcaagtcatcatggcccttacgggtagggctacacacgtgctacaatggccgatacagagggcggcgaaggggcgacctggagcaaatccttaaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttcggggggacgtttaccacggtgtggttcatgactggggtgaagtcgtaacaaggtagccgtaggggaacctgcggctggatcacctccttac

SEQ ID NO: 1154 - DNA, 1362 bp, Legionella sp. D3923
catgcttaacacatgcaagtcgaacggcagcacggtctagcttgctagatgggtggcgagtggcgaacgggtgagtaacgcgtaggaatatgccttaaagtttgggataacatggggaaactcatgctaataccggatgagctctgaggaggaaagctggggaccgtaaggcctggcgctttaagattagcctgcgtccgattagctagttggtggggtaagggcctaccaaggcgacgatcggtagctggtctgagaggatgaccagccacactgggactgagacacggcccagactcctacgggaggcagcagtggggaatattggacaatgggggcaaccctgatccagcaatgccgcgtgtgtgaagaaggcctgagggttgtaaagcactttcagtggggaggaggattgattggttaagagctgattgattggacgttacccacagaagaagcaccggctaactccgtgccagcagccgcggtaatacggagggtgcgagcgttaatcggaattactgggcgtaaagggtgcgtaggtggttgtataagttagctgtgaaatccccgggctcaacctgggcaggtcagctaagactgtatgactcgagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagttgttggccttatgaatgaggttagtgacgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgcattggtgccttcgggagcactgatacaggtgctgcatggctgtcgtcagctcgtgtcgtgagatgttgggttaagtcccgtaacgagcgcaacccttatccttagttgccagcgcgtgatggtgggaactctaaggagactgccggtgacaaaccggaggaaggcggggatgacgtcaagtcatcatggcccttacgggtagggctacacacgtgctacaatggccggtacagagggcagcgaaggggcgacctggagcaaatcttgtaaagctggtcgtagtccggattggagtctgcaactcgactccatgaagtcggaatcgctagtaatcgcgaatcagcatgtcgcggtgaatacgttcccgggccttgtacacaccgc

SEQ ID NO: 1155 - DNA, 1203 bp, Legionella sp. D4088
catgcttaacacatgcaagtcgaacgagtggcgaacgggtgagtaatgcgtaggaatatgccttgaagagggggataacccggggaaactcgggctaataccgcataatgaaaggcgctttaagattagcctacgtccgattagctagttggtggggtaagggcctaccaaggctgtgatcggtagctggtctgagaggatggacagccacactgggactgagacacggcccagactcctacgggaggcagcagtggggaatattggacaatggggggaaccctgatccagcaatgccgcgtgtgtgaagaaggcctgagggttgtaaagcactatcggtggggaggatgacgttacccacagaagaagcaccggctaactccgtgccagcagccgcggtaatacggagggtgcgagcgttaatcggaattactgggcgtaaagggtgcgtaggtggttttttaagttatctgtgaaattcctgggcttaacctgggctggtcagataagactggaagacttgagtatgggagagggcagtggaatttccggtgtagcggtgaaatgcgtagagatcggaaggaacaccagtggcgaaggcggctgcctggcctgactgacactgaggcacgaaagcgtgggtagcgaacaggattagataccctggtagtccacgctgtaaacgatgtcaactagctgttggctagttagtggcgcagcaaacgcgataagttgaccgcctggggagtacggtcgcaagactaaaactcaaaggaattgacgggggcccgcacaagcggtggagcatgtggtttaattcgatgcaacgcgaagaaccttacctacccttgacatatacaggtgctgcatggctgtcgtcagctcgtgtcgtgagatgttgggttaagtcccgtaacgagcgcaacccttattcctagttaccagcacgtggggactctagggagactgccggtgacaaaccggaggaaggcggggacgacgtcaagtcatcatggcccttacgggtagggctacacacgtgctacaatggacggcagagggcggcgaaggggcgacctggagcgaatccttactgttcgtagtccggatggagtctggaactcgactccagaagtcggaatcgctagtaatcgcgaatcagcatgtcgcggtgaatacgttcccgggccttgtacacaccgc

SEQ ID NO: 1156 - DNA, 1423 bp, Legionella sp. H63
aagtcgaacggcagcattttctagcttgctaggaagatggcgagtggcgaacgggtgagtaacgcgtaggaatatgccttaaagagggggataacatggggaaactcatgctaataccgcataatttcttaggaaaaaagctggggaccgtaaggcctggcgctttaagattagcctgcgtccgattagctagttggtggggtaagggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctgagggttgtaaagcactttcagtggggaggagtgattgataggttaagagctaattgattggacgttacccacagaagaagcaccggctaactccgtgccagcagccgcggtaatacggagggtgcaagcgttaatcggaattactgggcgtaaagggtgcgtaggtggtttggtaagttagttgtgaaatccctgggcttaacctgggaactgcaactaagactgtcagactcgagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggtcttataaatgagattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgcattggtgccttcgggagcactgatacaggtgctgcatggctgtcgtcagctcgtgtcgtgagatgttgggttaagtcccgtaacgagcgcaacccttgtccttagttgccagcatgtaatggtggggactctaaggagactgccggtgacaaaccggaggaaggcggggatgacgtcaagtcatcatggcccttacgggtagggctacacacgtgctacaatggccggtacagagggcagcgaaggggtgacctggagcaaatcttttaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaacctttggggggacgtttaccacggtgtgatt

SEQ ID NO: 1157 - DNA, 1508 bp, Legionella sp. NML 93L054
ggctcagattgaacgctggcggcatgcttaacacatgcaagtcgaacggcagcatggtccagcttgctggactgatggcgagtggcgaacgggtgagtaatgcgtaggaatatgccttgaagagggggataacccggggaaactcgggctaataccgcataatctcttaggaggaaagctggggaccttatggcctggcgctttaagattagcctacgtccgattagctagttggtggggtaagggcctaccaaggctgtgatcggtagctggtctgagaggatggacagccacactgggactgagacacggcccagactcctacgggaggcagcagtggggaatattggacaatggggggaaccctgatccagcaatgccgcgtgtgtgaagaaggcctgagggttgtaaagcactatcggtggggaggaagtttgattggttaagagctgattggattgacgttacccacagaagaagcaccggctaactccgtgccagcagccgcggtaatacggagggtgcgagcgttaatcggaattactgggcgtaaagggtgcgtaggtggttttttaagttatctgtgaaattcctgggcttaacctgggctggtcagataagactggaagacttgagtatgggagagggcagtggaatttccggtgtagcggtgaaatgcgtagagatcggaaggaacaccagtggcgaaggcggctgcctggcctgatactgacactgaggcacgaaagcgtgggtagcgaacaggattagataccctggtagtccacgctgtaaacgatgtcaactagctgttggctttatagataaagttagtggcgcagcaaacgcgataagttgaccgcctggggagtacggtcgcaagactaaaactcaaaggaattgacgggggcccgcacaagcggtggagcatgtggtttaattcgatgcaacgcgaagaaccttacctacccttgacatacagtggagcttgcagagatgcgagtgtgcctttgggaacactgatacaggtgctgcatggctgtcgtcagctcgtgtcgtgagatgttgggttaagtcccgtaacgagcgcaacccttattcctagttaccagcacgtgatggtggggactctagggagactgccggtgacaaaccggaggaaggcggggacgacgtcaagtcatcatggcccttacgggtagggctacacacgtgctacaatggacggtacagagggcggcgaaggggcgacctggagcgaatccttaaaagctgttcgtagtccggattggagtctggaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcggggggacgtttaccacggtgtggttcatgactggggtgaagtcgtaacaaggtagccgtaggggaacctgcgg

SEQ ID NO: 1158 - DNA, 1362 bp, Legionella steelei
catgcttaacacatgcaagtcgaacggcagcatgatctagcttgctagattgatggcgagtggcgaacgggtgagtaacgcgtaggaatatgccttgaagtgggggacaacttggggaaactcaagctaataccgcataatgtctaaggacgaaagctggggaccttagggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtagggaggaggattgctaggttaagagctaagtgattggacgttacctacagaagaagcaccggctaactccgtgccagcagccgcggtaatacggagggtgcaagcgttaatcggaattactgggcgtaaagcgtgcgtaggtggttaattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtaatggtgggaactctaaggagactgccggtgacaaaccggaggaaggcggggacgacgtcaagtcatcatggcccttacgggtagggctacacacgtgctacaatgggtgatacagagggaagcgaaggggtgacctggagctaatcttagaaagtcgctcgtagtccggattggagtctgcaactcgactccatgaagtcggaatcgctagtaatcgcgaatcagcatgtcgcggtgaatacgttcccgggccttgtacacaccgc

SEQ ID NO: 1159 - DNA, 1482 bp, Leminorella grimontii
ggcggcaggcctaacacatgcaagtcgaacggcagcgggaagtagcttgctactttgccggcgagtggcggacgggtgagtaatgtctgggaaactgcccgatggagggggataactactggaaacggtagctaataccgcatgacgtcttcggaccaaagagggggaccttagggcctcttgccatcggatgtgcccagatgggattagctagtaggcggggtaatggcccacctaggcgacgatccctagctggtctgagaggatgaccagccacactgggactgagacacggcccagactcctacgggaggcagcagtggggaatattgcacaatgggggaaaccctgatgcagccatgccgcgtgtgtgaagaaggccttcgggttgtaaagcactttcagcgaggaggaaggggttgtatttaatacatgcaatcattgacgttactcgcagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaactgcatttaaaactggtcagctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgcggatcagaatgccgcggtgaatacgttcccgggccttgtacacaccgcccgtcacaccatgggagtgggttgcaaaagaagtaggtagcttaaccttcgggggggcgcttaccactttgtgatccatgactggggtgaagtcgtaacaaggtaaccgtaggggaa

SEQ ID NO: 1160 - DNA, 1516 bp, Leminorella richardii
attgaacgctggcggcaggcctaacacatgcaagtcgaacggtagcaggaagaagcttgcttctttgctgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggcggggtaatggcccaccctaggcgacgatccctagctggtctgagaggatgaccagccacactgggactgagacacggcccagactcctacgggaggcagcagtggggaatattgcacaatgggcgcaagcctgatgcagccatgccgcgtgtgtgaagaaggccttcgggttgtaaagcactttcagcgaggaggaagggtgtggagttaataacttcatgcattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatttgaaactggtcagctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagtttgcagagatgcgaatgtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcacaaagtacgtcgtagtccggattggagtctgcaactcgactccatgaagtcggaatcgctagtaatcgcggatcagaatgccgcggtgaatacgttcccgggccttgtacacaccgcccgtcacaccatgggagtgggatgcaaaagaagtaggtagcttaaccttcgggggggcgcttaccactttgtgtttcatgactggggtgaagtcgtaacaaggtaaccgtaggggaacctgcggttggatcacctcctta

SEQ ID NO: 1161 - DNA, 1511 bp, Leptospira borgpetersenii
aacacggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaaggggagctaatactggatagtcccgagaggtcataggatttttcgggtaaagatttattgctcggagatgagcccgcgcccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaaagcagcgacgccgcgtgaacgatgaaaggtcttcggattgtaaagttcaataagcagggaaaaataagcagcgatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagagtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctccttt

SEQ ID NO: 1162 - DNA, 1293 bp, Leptospira broomii
aactaacgctggcggcgcgtcttaaacatgcaagtcgagcgagcggcgaacgggtgagtaacacgtgggtaatcttcctccgagtctgggataactttccgaaaggaaagctaataccggatagttaaagttgcttggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggaaaccctgaagcagcgacgccgcgtgaacgaagaaggtcttcggattgtaaagttcattaagcagggaaaatgatggtacctgcctaaagcaccggctaactacgtgccagcagccgcggtaatacgtatggtgcaagcgttgttcggaatcattgggcgtaaagggtgcgtaggcggatttgtaagtcaggtgtgaaaactgcgggctcaacccgtggcctgcacttgaaactacaagtctggagtttgggagaggcaagtggaattccaggtgtagcggtgaaatgcgtagatatctggaggaacaccagtggcgaaggcgacttgctggctcaactgacgctgaggcacgaaagcgtgggtagtaaacgggattagataccccggtaatccacgccctaaacgttgtctaccagttgttggggcctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatgcacaggtgctgcatggttgtcgtcagctcgtgtcgtgagatgttgggttaagtcccgcaacgagcgcaacccctatcgtatgttgctaccatgggcactcgtacgaaactgccggtgacaaaccggaggaaggcggggatgacgtcaaatcctcatggcctttatgtccagggccacacacgtgctacaatggccgacagagggtcgccaactcgcaagagggagctaatctctatcggtcccagttcggatggggtctgcaactcgaccccagaagtcggaatcgctagtaatcgcggatcagcatgccgcggtgaatacgttcccggaccttgtacacaccgcccgtcacaccacctgagtggggagcacccgaagtggtttgttagacagactactaaggtgaaactcgtaaagggggtg

SEQ ID NO: 1163 - DNA, 1508 bp, Leptospira interrogans
aacacggagagtttgatcctggctcagaactaacgctggcggcgcgtcttaaacatgcaagtcaagcggagtagcaatactcagcggcgaacgggtgagtaacacgtgggtaatcttcctctgagtctgggataactttccgaaagggaagctaatactggatggtcccgagagatcataagatttttcgggtaaagatttattgctcggagatgagcccgcgtccgattagctagttggtgaggtaaaggctcaccaaggcgacgatcggtagccggcctgagagggtgttcggccacaatggaatgagacacggtccatactcctacgggaggcagcagttaagaatcttgctcaatggggggaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaatccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctccttt

SEQ ID NO: 1164 - DNA, 1348 bp, Leptospira licerasiae
caagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggcgcaagcctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaaccctcagcctgcacttgaaactatgtgtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccatttagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggt

SEQ ID NO: 1165 - DNA, 1510 bp, Leptotrichia buccalis
agagtttgatcctggctcaggatgaacgctgacagaatgcttaacacatgcaagtctttggcgaatctgtgcttgcacaggctagccaaggcggacgggtgagtaacgcgtaaagaacttaccctgcagacagggataacagacggaaacgactgataatacctgatacaattgccagcacgcatgtgcccggcaatgaaaagtgatgctgcaggagagctttgcgtcctattagcttgttggtgaggtaatggctcaccaaggcgatgataggtagccggcctgagagggtgaacggccacaaggggactgagatacggcccttactcctacgggaggcagcagtggggaatattggacaatgggggcaaccctgatccagcaattctgtgtgcatgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaatgccgatgatgaagatagttcactggacggtaactgacgctgaagtgcgaaagctgggggagcgaacaggattagataccctggtagtcccagccgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctacgaatgcctgtgagaacaggcagtgccttcgggaacgtagagacaggtggtgcatggctgtcgacagctcgtgtcgtgagatgttgggttaagtcccgcaacgagcgcaacccctatcgctagttgccatcattaagttggggactctagcgagactgcctgcgaagagcaggaggaaggtggggatgacgtcaagtcatcatgccccttatgatctgggctacacacgtgctacaatggccggtacaaagagctgcaaaacggtaacgtttagccaatctttaaagccggtccaagttcggattgaagtctgcaactcgacttcatgaagccggaatcgctagtaatcgcagatcagcaatgctgcggtgaatacgttctcgggtcttgtacacaccgcccgtcacaccacgagagttgtttgcacctgaagccgccggtccaaccgtaaggaggaaggcgtctaaggtgtggatagtgattggggtgaagtcgtaacaaggtatccgtaccggaaggtgcggatggatcacctcctttctaag

SEQ ID NO: 1166 - DNA, 1294 bp, Leptotrichia genomosp. C1
gatgaacgctgacagaatgcttaacacatgcaagtctggcgagcggcggacgggtgagtaacgcgtaaggaacttgccctgcagtcagggataacagacggaaacgactgataagacctggtaaagaaaatgctgcaggagagccttgcgtcctattagcttgttggtggggtaacggcccaccaaggcaatgataggtagccggcctgagagggtggacggccacaaggggactgagatacggcccttactcctacgggaggcagcagtggggaatattggacaatgggggcaaccctgatccagcaattctgtgtgcacgatgaaggttttcggattgtaaagtgctttcagcagggaagatgacggtacctgcagaagaagcgacggctaaatacgtgccagcagccgcggtaatacgtatgtcgcaagcgttatccggaattattgggcataaagggcatctaggcggccagataagtctggggtgaaaacttgcggctcaaccgcaagcctgccctggaaactatgtggctagagtactggagaggtggacggaactgcacgagtagaggtgaaattcgtagatatgtgcaggaatgccgatggtgaagatagttcactggacggactgacgctgaagtgcgaaagctaggggagcaaacaggattagataccctggtagtcctagctgtaaacgatgattactgggtgtgggcatgtccgtgccgaagctaatgcgataagtaatccgcctggggagtacggccgcaaggctgaaactcaaaggaatagacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctattgctagttgccatcatgggaactctagcaagactgcctgcgaagagcaggaggaaggtggggatgacgtcaagtcatcatgccccttatgatctgggctacacacgtgctacaatggccggcagagagccgcaaggcggcaacgccaagccaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtctgcacctgaagctgccgtccaggaaagcatctaaggtgtggatagtgattggggtg

SEQ ID NO: 1167 - DNA, 1515 bp, Leptotrichia goodfellowii
ttgaatgaagagtttgatcctggctcaggatgaacgctgacagaatgcttaacacatgcaagtcgatggggaagaattaacttgttaatttggtaaccatggcggacgggtgagtaacgcgtaaagaacttacctttcagactgggataacagagggaaacttctgataagaccggatataattaattgattgcatgagagattaatgaaaagagatgctgaaagagagctttgcgtcctattagctagttggtaaggtaacggcttaccaaggcgatgataggtagccggcctgagagggtggacggccacaaggggactgagatacggcccttactcttacgggaggcagcagtggggaatattggacaatggaggagactctgatccagcaattctgtgtgcacgaagaaggttttcggattgtaaagtgctttcagtggggaagaaggaagtgacggtacccacagaagaagcgacggctaaatacgtgccagcagccgcggtaatacgtatgtcgcgagcgttatccggaattattgggcataaagggcatctaggcggacgatcaagtcaggggtgaaaacttgcggctcaactgtaagcttgcctttgaaactgattgtctagagtattggaaaggtgggcggaactacacgagtagaggtgaaattcgtagatatgtgtaggaatgccgatgatgaagatagctcactggacgataactgacgctgaagtgcgaaagctaggggagcgaacaggattagataccctggtagtcctagctgtaaacgatgatcactgggtgtgggcaggaagactgtctgtgccgaagcaaatgcgataagtgatccgcctggggagtacgaccgcaaggttgaaactcaaaggaattgacggggacccgcacaagcggtggagcatgtggtttaattcgacgcaacgcgaggaaccttaccagatcttgacatcctacgaacatgtatgaggatacatggtgccttcgggaacgtagagacaggtggtgcatggctgtcgacagctcgtgtcgtgagatgttgggttaagtcccgcaacgagcgcaacccttatcgttagttaccatcattaagttggggactctagcgagactgcctgcgaagagcaggaggaaggtggggatgacgtcaagtcatcatgccccttatgatctgggctacacacgtgctacaatgggcagtacagagaggagcgagatagtgatatggagcgaatcttgaaagctgttctaagttcggattgaagtctgcaactcgacttcatgaagttggaatcgctagtaatcgcaaatcagcaatgttgcggtgaatacgttctcgggtcttgtacacaccgcccgtcacaccacgagagttgtttgcacctgaagttactggtctaacttaggaggaaggtacctaaggtgtgaatagtgattggggtgaagtcgtaacaaggtatccgtaccggaaggtgcggatggatcacctcctttct

SEQ ID NO: 1168 - DNA, 1507 bp, Leptotrichia hofstadii
tgaagagtttgatcctggctcaggatgaacgctgacagaatgcttaacacatgcaagtctttggcgaatctgtgcttgcacaggctagccaaggcggacgggtgagtaacgcgtaaagaacttgccctgcagacagggataacagacggaaacgactgacaacacctgatacagttgccggcacgcatgtgcctggcaatgaaaagagatgctgcgggagagctttgcgtcctattagcttgttggcggggtaacggcccaccaaggcgatgataggtagccggcctgagagggtgaacggccacaaggggactgagatacggcccttactcctacgggaggcagcagtggggaatattggacaatgggggcaaccctgatccagcaattctgtgtgcacgatgaaggttttcggattgtaaagtgctttcagcagggaagaaggaagtgacggtacctgcagaagaagcgacggctaaatacgtgccagcagccgcggtaatacgtatgtcgcaagcgttatccggaattattgggcataaagggcatctaggcggccaggcaagtctggggtgaaaacttgcggctcaaccgcaagcctgccctggaaactgcctggctagagtgctggagaggtggacggaactgcacgagtagaggtgaaattcgtagatatgtgcaggaatgccgatgatgaagatagttcactggacggcaactgacgctgaagtgcgaaagctgggggagcgaacaggattagataccctggtagtcccagccgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcccacgtatgcctgcgagagcgggcagtgccttcgggaacgtggagacaggtggtgcatggctgtcgacagctcgtgtcgtgagatgttgggttaagtcccgcaacgagcgcaacccctatcgccagttgccatcattaagttggggactctggcgagactgcctgcgaagagcaggaggaaggtggggatgacgtcaagtcatcatgccccttatgatctgggctacacacgtgctacaatggccggtacagagagctgcgaagcggcaacgcccagcgaatcttcaaagccggtccaagttcggattgaagtctgcaactcgacttcatgaagctggaatcgctagtaatcgcagatcagcaatgctgcggtgaatacgttctcgggtcttgtacacaccgcccgtcacaccacgagagttgtctgcacctgaagctgccggtctaaccgcaaggaggaaggcatctaaggtgtggacagtgattggggtgaagtcgtaacaaggtatccgtaccggaaggtgcggatggatcacctcctt

SEQ ID NO: 1169 - DNA, 1485 bp, Leptotrichia shahii
gagtttgatyctggctcaggatgaacgctgacagaatgcttaacacatgcaagtctttggcgaagctgcgcttgcgcagacgagccaaggcggacgggtgagtaacgcgtaaggaacttgccctgcagacagggataacagacggaaacgactgacaagacctgatacagttgccggcacgcatgtgcctggcgatgaaaggagacgctgcaggagagccttgcgtcctattagcttgttggcggggtaatggcccaccaaggcgatgataggtagccggcctgagagggtggacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcgagcgttatccggaattattgggcataaagggcatctaggcggccctgtaagtctagggtgaaaacctgcggctcaaccgcaggcctgccccggaaactacagggctagagtgctggagaggtggacggaactgcacgagtagaggtgaaattcgtagatatgtgcaggaatgccgatgatgaagatagttcactggacggcaactgacgctgaagtgcgaaagctaggggagcaaacaggattagataccctggtagtcctagctgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcgaaggcctgcgagagcaggccgtgccttcgggaacgcagagacaggtggtgcatggctgtcgacagctcgtgtcgtgagatgttgggttaagtcccgcaacgagcgcaacccctatcgctagttgccatcattaggttggggactctagcgagactgcctgcgaagagcaggaggaaggcggggatgacgtcaagtcatcatgccccttatgatctgggctacacacgtgctacaatggccggtacaaagagctgccaggcggcaacgccaagcgaatctttaaagccggtccaagttcggattgaagcctgcaactcggcttcatgaagctggaatcgctagtaatcgcagatcagcaatgctgcggtgaatacgttctcgggtcttgtacacaccgccgtcacaccacgagagttgtctgcacctgaagccgccggtccaaccgaaaggaggaaggcgtctaaggtgtggacagtgattggggtgaagtcgtaacaaggtatccgtaccggaaggtgc

SEQ ID NO: 1170 - DNA, 1506 bp, Leptotrichia sp. neutropenicPatient
tggagagtttgatcctggctcaggatgaacgctgacagaatgcttaacacatgcaagtcattggcgaagctgcgcttgcgcagtctagccaaggcggacgggtgagtaacgcgtaaggaacttgccctgcagacagggataacagacggaaacgactgataacacctggtattgtcaggctggcgcatgccggcctgatgaaaggagacgctgcaggagagccttgcgtcctattagctagttggtggggtaacggcccaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggccgccctgtaagtctagggtgaaaacctgcggctcaaccgcaggcctgccccggaaactacagggctagagtatcggagaggtggacggaactgcacgagtagaggtgaaattcgtagatatgtgcaggaatgccgatgatgaagatagttcactggacggtaactgacgctgaagtgcgaaagctaggggagcaaacaggattagataccctggtagtcctagctgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcgaatgcccgtgagaacgggcagtgccttcgggaacgcagagacaggtggtgcatggctgtcgacagctcgtgtcgtgagatgttgggttaagtcccgcaacgagcgcaacccctatcgttagttgccatcattaagttggggactctagcgagactgcctgcgaagagcaggaggaaggtggggatgacgtcaagtcatcatgccccttatgatctgggctacacacgtgctacaatggccggtacagagagcagccaggcggcaacgccgagcgaatctttaaagccggtccaagttcggattgaagcctgcaactcggcttcatgaagctggaatcgctagtaatcgcagatcagcaatgctgcggtgaatacgttctcgggtcttgtacacaccgcccgtcacaccacgagagttgtctgcacctgaagctgctggtccaaccgcaaggaggaaggcatctaaggtgtggatagtgattggggtgaagtcgtaacaaggtatccgtaccggaaggtgcggytggatcacctcctt

SEQ ID NO: 1171 - DNA, 1363 bp, Leptotrichia sp. oral clone GT018
gagtttgattctggctcaggatgaacgctgacagaatgcttaacacatgcaagtctggcgagcggcggacgggtgagtaacgcgtaaggaacttgccctgcagtcagggataacagacggaaacgactgataagacctggtaaagaaaatgctgcaggagagccttgcgtcctattagcttgttggtggggtaacggcccaccaaggcgatgataggtagccggcctgagagggtggacggccacaaggggactgagatacggcccttactcctacgggaggcagcagtggggaatattggacaatgggggcaaccctgatccagcaattctgtgtgcacgatgaaggttttcggattgtaaagtgctttcagcagggaagatgacggtacctgcagaagaagcgacggctaactacgtgccagcagccgcggtaatacgtatgtcgcaagcgttatccggaattattgggcataaagggcatctaggcggccagataagtctggggtgaaaacttgcggctcaaccgcaagcctgccctggaaactatgtggctagagtactggagaggtggacggaactgcacgagtagaggtgaaattcgtagatatgtgcaggaatgccgatgatgaagatagttcactggacggactgacgctgaagtgcgaaagctaggggagcaaacaggattagataccctggtagtcctagctgtaaacgatgattactgggtgtgggcatgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctattgctagttgccatcatgggaactctagcaagactgcctgcgaagagcaggaggaaggtggggatgacgtcaagtcatcatgccccttatgatctgggctacacacgtgctacaatggctggcagagagatgcgacgcagcaatgccaagccaacctctccagtccaagttcggatgaagcctgcaactcggcttcagaagttggaatcgctagtaatcgcggatcagcaatgccgcggtgaatacgttctcgggccttgtacacaccgcccgtcacaccacgagagttgtctgcacctgaagctgccgtctaagaaggcatctaaggtgtggacagtgattggggtgaagtcgtaacaaggtatccgtaccggaaggtgcggctggatcacctcctt

SEQ ID NO: 1172 - DNA, 1362 bp, Leptotrichia sp. oral clone GT020
gagtttgatcctggctcaggatgaacgctgacagaatgcttaacacatgcaagtctttgcaaggcggacgggtgagtaacgcgtaaagaacttgccctgcagtctgggataacagacggaaacgactgataaaacctgatatagaaaatgctgcaggagagctttgcgtcctattagcttgttggtggggtaatggcccaccaaggcaatgataggtagccggcctgagagggtgaccggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgactgtacctgcagaagaagcgacggctaaatacgtgccagcagccgcggtaatacgtatgtcgcaagcgttatccggaattattgggcataaagggcatctaggcggccagataagtctggggtgaaaacttgcggctcaaccgcaagcctgccctggaaactatatggctagagtactggagaggtggacggaactgcacgagtagaggtgaaattcgtagatatgtgcaggaatgccgatgatgaagatagttcactggacggactgacgctgaagtgcgaaagctaggggagcaaacaggattagataccctggtagtcctagctgtaaacgatgattactgggtgtgggcatgtctgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgttagttgccatcatgggaactctagcgagactgcctgcgaagagcaggaggaaggtggggatgacgtcaagtcatcatgccccttatgatctgggctacacacgtgctacaatggccggcaaaaagctgcaaaacggtaacgtttagccaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtctgcacctgaagctgccgtctaagaaggtatctaaggtgtggatagtgattggggtgaagtcgtaacaaggtatccgtaccggaaggtgcggctggatcacctcctt

SEQ ID NO: 1173 - DNA, 1363 bp, Leptotrichia sp. oral clone HE012
gagtttgattctggctcaggatgaacgctgacagaatgcttaacacatgcaagtctggcgagcggcggacgggtgagtaacgcgtaaagaacttgccctgcagacagggataacagacggaaacgactgataacacctgatacagaaaatgctgcgggagagctttgcgtcctattagcttgttggtgaggtaacggctcaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgacggtacctgcagaagaagcgacggctaattacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaataccgatgatgaagatagttcactggacggactgacgctgaagtgcgaaagctaggggagcgaacaggattagataccctggtagtcctagctgtaaacgatgattactgggtgtggacatgtccgtgccgaagcaaatgcgataattaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgttagttaccatcatggggactctagcgagactgcctgcgaagagcaggaggaaggtggggatgacgtcaagtcatcatgccccttatgatctgggctacacacgtgctacaatggccggcagagagctgcgaagcggcaacgcccagcgaatctttccggtccaagttcggatgaagtctgcaactcgacttcagaagctggaatcgctagtaatcgcagatcagcaatgctgcggtgaatacgttctcgggtcttgtacacaccgcccgtcacaccacgagagttgtttgcacctgaagctgccgtctaggaaggcatctaatgtgtggatagtgattggggtgaagtcgtaacaaggtatccgtaccggaaggtgcggttggaacacctcctt

SEQ ID NO: 1174 - DNA, 1362 bp, Leptotrichia sp. oral clone IK040
gagtttgatcctggctcaggatgaacgctgacagaatgcttaacacatgcaagtcgatggatggcggacgggtgagtaacgcgtaaagaacttgccggatggaccgggataacagctggaaacggctggcaagaccggatactgaaaatgccgtccgagagctttgcgtcctattagctggttggtaaggtgacggcttaccaaggcgatgataggtagccggcctgagagggtggacggccacaaggggactgagatacggcccttactcctacgggaggcagcagtggggaatattggacaatgggggcaaccctgatccagcaattctgtgtgcacgaagaaggttttcggatcgtaaagtgctttcagcagggaggatgactgtacctgcagaagaagcgacggctaaatacgtgccagcagccgcggtaatacgtatgtcgcgagcgttatccggaattattgggcataaagggcatctaggcggccgggtaagtccggggtgaaaactgctggctcaaccagcagcctgccttggaaactacccggcttgagtgctggagaggtggacggaactgcacgagtagaggtgaaattcgtagatatgtgcaggaatgccgatgatgaagatagttcactggacggactgacgctgaagtgcgaaagctaggggagcgaacaggattagataccctggtagtcctagctgtaaacgatgattactgggtgtgggcatgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaacccctatcgctagttgccatcatggggactctagcgagactgcctgcgaagagcaggaggaaggtggggatgacgtcaagtcatcatgccccttatgatctgggctacacacgtgctacaatggctggcagagagatgcgacgcagcaatgccaagccaacctctccagtccaagttcggatgaagcctgcaactcggcttcagaagttggaatcgctagtaatcgcggatcagcaatgccgcggtgaatacgttctcgggtcttgtacacaccgcccgtcacaccacgagagttgtctgcacctgaagctgccgtctaagaaggcatctaaggtgtggacagtgattggggtgaagtcgtaacaaggtatccgtaccggaaggtgcggctggaacacctcctt

SEQ ID NO: 1175 - DNA, 1293 bp, Leptotrichia sp. oral clone P2PB_51 P1
gatgaacgctgacagaatgcttaacacatgcaagtcgatggatggcggacgggtgagtaacgcgtaaggaacttacctgcgggactgggataacggagggaaacttctgacaagaccggataaagaaagcgcctgcggagagtcttgcgtcctattagctagttggttgggtaacggctgaccaaggcgaagataggtagccggcctgagagggtggacggccacaaggggactgagatacggcccttactcctacgggaggcagcagtggggaatattggacaatgggggcaaccctgatccagcaattctgtgtgcacgaagaaggttttcggattgtaaagtgctttcagcagggaagatgacggtacctgcagaagaagcgacggctaaatacgtgccagcagccgcggtaatacgtatgtcgcgagcgttatccggaattattgggcataaagggcatctaggcggcctaacaagtcaggggtgaaaacctgcggctcaaccgcaggcctgcctttgaaactgtaaggctggagtaccggagaggtggacggaactgcacgagtagaggtgaaattcgtagatatgtgcaggaatgccgatgatgaagatagtccactggacggactgacgctgaagtgcgaaagccgggggagcgaacaggattagataccctggtagtcccggccgtaaacgatgattactgggtgtgggcatgtctgtgccgaagcgaatgcgataagtaatccgcctggggagtacggccgcaaggctggaactcaaaggaattgacggggacccgcacaagcggtggagcatgtggtttaattcgacgcaacgcgaggaaccttaccagatcttgacatcgacaggtggtgcatggctgtcgacagctcgtgtcgtgagatgttgggttaagtcccgcaacgagcgcaaccctttttgctagttaccatcatggggactctagcgagactgcctgcgaagagcaggaggaaggtggggatgacgtcaagtcatcatgccccttatgatctgggctacacacgtgctacaatgggctgcagagaggagcgaggtggtgacacggagcgaatcttgcagttcgaagttcggatgaagtctgcaactcgacttcagaagttggaatcgctagtaatcgcggatcagcaatgccgcggtgaatacgttctcgggtcttgtacacaccgcccgtcacaccacgagagttgtctgcacctgaagttactgtctaggaaggtacctaaggtgtggatagtgattggggtg

SEQ ID NO: 1176 - DNA, 1432 bp, Leptotrichia sp. oral taxon 223
gatgaacgctgacagaatgcttaacacatgcaagtctttggcgaatctgcgcttgcccaggctagccaaggcggacgggtgagtagcgcgtaaagaacttgccctgcagacagggataacagacggaaacgactgacaacacctgatacggttgccggcacgcatgtgccaggcaatgaaaagcgatgctgcaggagagctttgcgtcctattagcttgttggtgaggtaacggctcaccaaggcgacgataggtagccggcctgagagggtgaacggccacaaggggactgagatacggcccttactcctacgggaggcagcagtggggaatattggacaatgggggcaaccctgatccagcaattctgtgtgcacgaagaaggctttcgggctgtaaagtgctttcagcagagaagaagcaagtgacggtacctgcagaagaagcgacggctaaatacgtgccagcagccgcggtaatacgtatgccgcaagcgttatccggaattattgggcataaagggcatctaggcggccaggcaagtctggggtgaaaacctgcggctcaaccgcaggcctgccctggaaactgcgtggctagagtgctggagaggtggacggaactgcacgagtagaggtgaaattcgtagatatgtgcaggaatgccgatgatgaagatagttcactggacggcaactgacgctgaagtgcgaaagccgggggagcgaacaggattagataccctggtagtcccggccgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcggatgcccgtgagagcgggcagtgccctcgggaacgcagagacaggtggtgcatggctgtcgacagctcgtgtcgtgagatgttgggttaagtcccgcaacgagcgcaacccctatcgccagttgccatcattaggttggggactctggcgagactgcctgcgaagagcaggaggaaggtggggatgacgtcaagtcatcatgccccttatgatctgggctacacacgtgctaccatggccggtacagagagctgcgaggcggcgacgccaagcgaacctgcaaagccggtccaagttcggattgaagcctgcaactcggcttcatgaagctggaatcgctagtaatcgcagatcagcaatgctgcggtgaatacgttctcgggtcttgtacacaccgcccgtcacaccacgagagctgtctgcacctgaagccgccggtccaaccgcaagggggaaggcgtctaaggtgtggacagtgattgggg

SEQ ID NO: 1177 - DNA, 1450 bp, Leuconostoc carnosum
cgcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaacttagtatcgcatgataccaggttaaaaggcgctacggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaaaagttaaggtagggaatgaccttagcctgacggtaccataccagaaagggacggctaaatacgtgccagcagccgcggtaatacgtatgtcccgagcgttatccggatttattgggcgtaaagcgagcgcagacggttggttaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagaaatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatggaagtttgtaatgcccaaagccggtggcctaaccgtaaggagggaaccgtctaaggcaggacag

SEQ ID NO: 1178 - DNA, 1576 bp, Leuconostoc citreum
gaattcactagtgattagagtttgattaatggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatatcaagttaaaaggcgccacggcgtcacctagagatggatccgcggtgcattagttagttggtggggtaaaggcttaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaaatgctaaaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataaccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcagactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttcgggagggagccgtctaaggcaggacagatgactggggtgaagtcgtaacaaggtaaccgtaaatcgaatttcccgcggccgccatggcggccggagctgratcgc

SEQ ID NO: 1179 - DNA, 1554 bp, Leuconostoc gasicomitatum
tttaaattgagagtttgatcctggctcaggatgaacgctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaataaaacttagtatcgcatgataccaggttaaaaggcgctacggcgtcacctagagatggatccgcggtgcattagttagttggtggggtaaaggcttaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttct

SEQ ID NO: 1180 - DNA, 1474 bp, Leuconostoc inhae
ctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaatgagacttcttgttgcatgacaggaagttaaaaggcgctacggcgtcgcctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaaaggcattggaaactggtcaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaagttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaaca

SEQ ID NO: 1181 - DNA, 1558 bp, Leuconostoc kimchii
ttaaattgagagtttgatcctggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatataaagttaaaaggcgctacggcgtcacctagagatggatccgcggtgcattagttagttggtgaggtaaaggctcaccaagacaatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacagctagaatagggaatgattttagtgtgacggtaccataccagaaagggacggctaaatacgtgccagcagccgcggtaatacgtatgtcccgagcgttatccggatttattgggcgtaaagcgagcgcagacggttgtttaagtctgatgtgaaagcccggagctcaactccggaaaggcattggaaactggacaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 1182 - DNA, 1451 bp, Leuconostoc lactis
ggcggcgtgcctaatacatgcaagtcgaacgcgcagcgaaaggtgcttgcacctttcaagcgagtggcgaacgggtgagtaacacgtggataacctgcctcaaggctggggataacatttggaaacagatgctaataccgaataaaacttagtatcgcatgatacaaagttgaaaggcgctacggcgtcacctagagatgggtccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttagggtcgtaaagcactgttgtatgggaagaaatgctagaatagggaatgattctagttcgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttctagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttatggagggagccgtctaaggcaggacaga

SEQ ID NO: 1183 - DNA, 1555 bp, Leuconostoc mesenteroides
ttcaaattgagagtttgatcctggctcaggatgaacgctggcggcgtgcctaatacatgcaagtcgaacgcatagcgaaaggtgcttgcacctttcaagtgagtggcgaacgggtgagtaacacgtggacaacctgcctcaaggctggggataacatttggaaacagatgctaataccgaataaaacttagtgtcgcatgacacaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgataaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttct

SEQ ID NO: 1184 - DNA, 1448 bp, Leuconostoc pseudomesenteroides
gcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaactcagtgtcgcatgacacaaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttagggggagccgtctaaggcaggaca

SEQ ID NO: 1185 - DNA, 1549 bp, Listeria grayi
gagagtttgatcctggctcaggacgaacgctggcggcgtgcctaatacatgcaagtcgaacgaatgaccttaggagcttgctcctttggtcgttagtggcggacgggtgagtaacacgtgggcaacctgcctgtaagattgggataactccgggaaaccggagctaataccgaataataatcagctccgcatggagcgggtttgaaaggcggcttcggctgtcacttacagatgggcccgcggtgcattagctagttggtggggtaaaggcctaccaaggcgacgatgcatcgccgacctgagagggtgatcggccacactgggactgagacacggcccagactcctccgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagacttagagtgcagaagaggagagtggaattccatgtgtagcggtgaaatgccgagatatatggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgacggtgcaagccggaggaaggtggggatgacgtcaaatcatcatgccccttatgacctgggctacacacgtgctacaatggatgatacaaagggtcgcgaagccgcgaggtgaagctaatcccataaaatcattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttct

SEQ ID NO: 1186 - DNA, 1514 bp, Listeria innocua
agagtttgatcctggctcaggacgaacgctggcggcgtgcctaatacatgcaagtcgaacgaacggaggaagagcttgctcttccaatgttagtggcggacgggtgagtaacacgtgggcaacctgcccgtaagttggggataactccgggaaaccggggctaataccgaatgatagagtgtgacgcatgtcacactcttgaaagatggtttcggctatcgcttacagatgggcccgcggtgcattagctagttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccccgtgtatcgctgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatggagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtaaccgta

SEQ ID NO: 1187 - DNA, 1487 bp, Listeria ivanovii
  modified_base (251)..(251): a, c, t, g, unknown or other
  modified_base (533)..(533): a, c, t, g, unknown or other
  modified_base (573)..(573): a, c, t, g, unknown or other
  modified_base (593)..(593): a, c, t, g, unknown or other
  modified_base (602)..(602): a, c, t, g, unknown or other
  modified_base (621)..(621): a, c, t, g, unknown or other
  modified_base (629)..(630): a, c, t, g, unknown or other
  modified_base (654)..(654): a, c, t, g, unknown or other
  modified_base (742)..(742): a, c, t, g, unknown or other
  modified_base (829)..(829): a, c, t, g, unknown or other
  modified_base (853)..(853): a, c, t, g, unknown or other
  modified_base (887)..(887): a, c, t, g, unknown or other
  modified_base (968)..(968): a, c, t, g, unknown or other
  modified_base (983)..(983): a, c, t, g, unknown or other
  modified_base (1025)..(1025): a, c, t, g, unknown or other
  modified_base (1052)..(1052): a, c, t, g, unknown or other
  modified_base (1057)..(1057): a, c, t, g, unknown or other
  modified_base (1060)..(1060): a, c, t, g, unknown or other
  modified_base (1091)..(1091): a, c, t, g, unknown or other
  modified_base (1171)..(1171): a, c, t, g, unknown or other
  modified_base (1193)..(1193): a, c, t, g, unknown or other
  modified_base (1325)..(1325): a, c, t, g, unknown or other
  modified_base (1371)..(1371): a, c, t, g, unknown or other
  modified_base (1401)..(1401): a, c, t, g, unknown or other
  modified_base (1444)..(1444): a, c, t, g, unknown or other
gagagtttgatcctggctcaggacgaacgctggcggcgtgcctaatacatgcaagtcgaacgaacggaggaagagcttgctcttccaatgttagtggcggacgggtgagtaacacgtgggcaacctgcctgtaagttggggataactccgggaaaccggggctaataccgaatgataagtagtgacgcatgtcatcactttgaaagatggtttcgctatcgcttacagatgggcccgcggtgcattagctngttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtnatacgtaggtggcaagcgttgtccggatttattgggcgtnaagcgcgcgcaggcggtctnttaagtctnatgtgaaagcccccggctnaaccgggnngggtcattggaaactggaagactngagtgcagaagaggagagtggaattccacgtgtagcggtgaaatgcgtagatatgtggaggaacaccagtggcgaaggcgactctctngtctgtaactgacgctgaggcgcgaaagcgtggggagcaaacaggattagataccctggtagtccacgccgtaaacgatgagtgctnagtgttagggggtttccgcccctnagtgctgcagctaacgcattaagcactccgcctngggagtacgaccgcaaggttgaaactcaaaggaattgacgggggccgcacaagcggtggagcatgtggtttaattcgaagnaacgcgaagaacctnaccaggtcttgacatcctttgaccactctggagacagagctntccttcggggacaaagtgacaggtggngcatngtngtcgtcagctcgtgtcgtgagatgttgggtnaagtcccgcaacgagcgcaacccttgattttagttgccagcatttagttgggcactctaaagtgactgccggtgcaagcnggaggaaggtggggatgacgtnaaatcatcatgccccttatgacctgggctacacacgtgctacaatggatggtacaaagggtcgcgaagccgcgaggtggagccaatcccataaaaccattctcagttcggattgtaggctgcaactcgcctncatgaagccggaatcgctagtaatcgcggatcagcatgccgcggtnaatacgttcccgggccttgtacacaccgcncgtcacaccacgagagtttgtaacacccgaagtcggtagggtnaccttttaggagccagccgccgaaggtgggacagatgattggg

SEQ ID NO: 1188 - DNA, 1556 bp, Listeria monocytogenes
attttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaatgatagaatgtggcgcatgccacgcttttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatagtacaaagggtcgcgaagccgcgaggtggagctaatcccataaaactattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaa

SEQ ID NO: 1189 - DNA, 1555 bp, Listeria welshimeri
tattttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaataataagtggtggcgcatgccacggctttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttaattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttct

SEQ ID NO: 1190 - DNA, 1247 bp, Luteococcus sanguinis
aacgggtgagtaacacgtgagtaacctgccccaaactctgggataacagtcggaaacggctgctaataccggatatggaaaggcggtttgggatggactcgcggcctatcagcttgttggtgaggtagtggctcaccaaggcttcgacgggtagccggcctgagagggcgaccggccacattgggactgagatacggcccaaactcctacgggaggcagcagtggggaatattgcacaatgggcgaaagcctgatgcagcaacgccgcgtgcgggatgacggccttcgggttgtaaaccgctttcagcgcagacgatgacggtatgcgcagaagaagcaccggccaactacgtgccagcagccgcggtgatacgtagggtgcgagcgttgtccggaattattgggcgtaaagagcttgtaggcggtttgttgcgtcagaagtgaaaactcagggcttaaccctgagcctgcttctgatacgggcagactagaggaagttaggggagaacggaattcctggtggagcggtggaatgcgcagatatcaggaggaacaccggtggcgaaggcggttctctgggactcctgacgctgagaagcgaaagcgtggggagcaaacaggcttagataccctggtagtccacgccgtaaacggtgggtactaggtgtgggtcgatccgtgccgcagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgcacaggtggtgcatggctgtcgtcagctcgtgtcgtgagatgttgggttaagtcccgcaacgagcgcaaccctcgtccaatgttgccagcggccggggactcattggagaccgccggggtcaactcggaggaaggtggggatgacgtcaagtcatcatgccccttatgtccagggcttcacgcatgctacaatggccggcaaagggctgcgaacctgcaagggtgagcgaatcccaaccggtctcagttcggatggggtctgcaactcgaccccagaagtcggagtcgctagtaatcgcagatcagcaacgctgcggtgaatacgttcccggggcttgtacacaccgcccgtcaagtcatgaaagtcggtaacacccgaagccggtgcctagggagccgtcgaaggtgggaccggtaattagg

SEQ ID NO: 1191 - DNA, 1438 bp, Lutispora thermophila
gacgaacgctggcggcgtgcctaacacatgcaagtcgaacggagatggtgggatagcttgctattttatcatcttagtggcggacgggtgagtaacacgtgggcaacctgccctaaagagggggataacaccgagaaatcggtgctaataccgcatgaaattagagtttcgcatgaagctttaatcaaaggagcaatccgctttaggatgggcccgcgtctgattagctagttggtgaggtaacggctcaccaaggcgacgatcagtagccgatctgagaggatgaccggccacactggaactgagacacggtccagactcctacgggaggcagcagtggggaatattgcacaatgggggaaaccctgatgcagcaacgccgcgtggaggaagaaggtcttcggattgtaaactcctgtcttctgggacgaaatatgacggtaccagaggaggaagccacggctaactacgtgccagcagccgcggtaatacgtaggtggcgagcgttgtccggaattactgggcgtaaagggcgcgtaggcggcctgttaagtcagatgtgaaaaccccgggctcaacctggggagtgcatttgaaactgatgggctagagtgtcggagagggaagcggaattcctagtgtagcggtgaaatgcgtagatattaggaggaacaccagtggcgaaggcggctttctggacgataactgacgctgaggcgcgaaagcgtggggagcaaacaggattagataccctggtagtccacgctgtaaacgatggatactaggtgtgggaggtatcgaccccttccgtgccgcagtaaacgcaataagtatcccgcctggggagtacggccgcaaggttgaaactcaaaggaattgacgggggcccgcacaagcagcggagcatgtggtttaattcgaagcaacgcgaagaaccttaccagagcttgacatctcctgcatagtccgtaatgggatgaagtccttcgggacaggaagacaggtggtgcatggttgtcgtcagctcgtgtcgtgagatgttgggttaagtcccgcaacgagcgcaacccttatacttagttgccatcattaagttgggcactctaagtagactgccggagacaattcggaggaaggtggggatgacgtcaaatcatcatgccccttatgttctgggctacacacgtgctacaatgggtataacaacgggaagcaagccagtgatggtaagcaaatccctaaaaagtactcccagttcagattgttctctgaaactcgagaacatgaagtcggagttgctagtaatcgcgaatcagcatgtcgcggtgaatacgttcccgggccttgtacacaccgcccgtcacaccatgggagttggaagcacccgaagccggtgacttaaccgcaaggagagagccgtcgaaggtgaagccaatga

SEQ ID NO: 1192 - DNA, 1356 bp, Lysinibacillus fusiformis
ggggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaa

SEQ ID NO: 1193 - DNA, 1541 bp, Lysinibacillus sphaericus
agagtttgatcctggctcaggacgaacgctggcggcgtgcctaatacatgcaagtcgagcgaacagagaaggagcttgctcctttgacgttagcggcggacgggtgagtaacacgtgggcaacctaccttatagtttgggataactccgggaaaccggggctaataccgaataatctatttcacctcatggtgaattattgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgacactgtaagatatggtttccccttcgggggcacggtgacaggtggtgcatggattgtcgtcagctcgtgtcgtgagatgttgggttaagtcccgcaacgagcgcaaccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgtccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctt

SEQ ID NO: 1194 - DNA, 1547 bp, Macrococcus caseolyticus
agagtttgatcctggctcaggatgaacgctggcggcgtgcctaatacatgcaagtcgagcgaacggacgagagtgcttgcactctctgatgttagcggcggacgggtgagtaacacgtgggtaacctacctataagactgggataacttcgggaaaccggagctaataccggataatatttagcttcgcatgaagcaatagtgaaagacggttctgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaggttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctccttt

SEQ ID NO: 1195 - DNA, 1516 bp, Mannheimia haemolytica
agagtttgatcatggctcagattgaacgctggcggcaggcttaacacatgcaagtcgaacggtagcacataggagtttgctccttgggtgacgagtggcggacgggtgagtaatgcttgggaatctggcttatggagggggataactactggaaacggtagctaataccgcgtaatgtcttaggactaaagggtgggaccatttggccacctgccataagatgagcccaagtgggattaggtagttggtgaggtaaaggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggcgattgttttaatagaacagtcgattgacgttaatcacagaagaagcaccggctaactccgtgccagcagccgcggtaatacggggggtgcgagcgttaatcggaataactgggcgtaaagggcacgcaggcggttgtttaagtgaggtgtgaaagccccgggcttaacctgggaattgcatttcagactgaacaactagagtactttagggaggggtagaattccacgtgtagcggtgaaatgcgtagagatgtggaggaataccgaaggcgaaggcagccccttggaaatgtactgacgctcatgtgcgaaagcgtggggagcaaacaggattagataccctggtagtccacgccgtaaacgctgtcgatttggggattggggtttaactctggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatatgagagtgccttcgggaaccatgagacaggtgctgcatggctgtcgtcagctcgtgttgtgaaatgttgggttaagtcccgcaacgagcgcaacccttatcctttgttgccagcgattaggtcgggaactcaaaggagactgccggtgataaaccggaggaaggtggggatgacgtcaagtcatcatggcccttacgagtagggctacacacgtgctacaatggcgtatacagagggcggcgagccagcgatggggagcgaatctcagaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcg

SEQ ID NO: 1196 - DNA, 1300 bp, Marvinbryantia formatexigens
tggcggcgtgcttaacacatgcaagtcgagcgagcggcggacgggtgagtaacgcgtggataacctgccttatacagggggataacagccagaaatggctgctaataccgcataagaaaaagtggtataagatgggtccgcgttggattaggcagttggcggggtaaaggcccaccaaaccgacgatccatagccggcctgagagggtggacggccacattgggactgagacacggcccagactcctacgggaggcagcagtggggaatattgcacaatgggggaaaccctgatgcagcgacgccgcgtgggtgaagaagtatttcggtatgtaaagccctatcagcagggaagatgacggtacctgaccaagaagccccggctaactacgtgccagcagccgcggtaatacgtagggggcaagcgttatccggatttactgggtgtaaagggagcgtagacggccatgcaagtctggtgtgaaaggcgggggctcaacccccggactgcattggaaactgtatggcttgagtgccggagaggtaagcggaattcctggtgtagcggtgaaatgcgtagatatcaggaggaacaccagtggcgaaggcggcttactggacggactgacgttgaggctcgaaagcgtggggagcaaacaggattagataccctggtagtccacgccgtaaacgatgaataccaggtgtcggggcttcggtgccgcagcaaacgcactaagtattccacctggggagtacgttcgcaagaatgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctgttcccagtagccagcatatgggcactctggggagactgccagggataacctggaggaaggcggggatgacgtcaaatcatcatgccccttatgatctgggctacacacgtgctacaatggcgtgcagagggaagcgaacccgcgagggggagcaaatcccagaacgtcccagttcggatgtagtctgcaacccggctacagaagctggaatcgctagtaatcgcggatcagcatgccgcggtgaatacgttcccgggtcttgtacacaccgcccgtcacaccatgggagtcggaaatgcccgaagtcagtacccagggagctgccgaaggcggggccggtaactggggtgaagtcgtaacaa

SEQ ID NO: 1197 - DNA, 1450 bp, Massilia sp. CCUG 43427A
acgctggcggcatgctttacacatgcaagtcgaacggtaacagggagcttgctccgctgacgagtggcgaacgggtgagtaatatatcggaacgtacccagaagtgggggataacgtagcgaaagttacgctaataccgcatacgatccacggatgaaagtaggggaccttcgggccttatgcttttggagcggccgatatctgattagctagttggtagggtaaaggcctaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtagaggctaatatcctttgctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctagaatctggcagaggggggtagaattccacgtgtagcagtgaaatgcgtagagatgtggaggaacaccgatggcgaaggcagccccctgggtcaagattgacgctcatgcacsaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaatgccgaagagatttggcagtgctcgaaagagaaccgtaacacaggtgctgcatggctgtcgtcagctcgtgtcgtgagatgttgggttaagtcccgcaacgagcgcaacccttgtcattagttgctacattcagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgtagtctgcaactcgactacgtgaagttggaatcgctagtaatcgcggatcagcatgccgcggtgaatacgttcccgggtcttgtacacaccgcccgtcacaccatgggagcgggttttaccagaagtaggtagcttaaccgcaaggagggcgcttaccacggtaggattcgtgactgggg

SEQ ID NO: 1198 - DNA, 1342 bp, Megamonas funiformis
ctttgacataagcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaaggataaggattataatacagtctttgtttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgactccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacattgattgaaagacttagagataagttccttctcttcggagaacaagaaaacaggtggtgcatggctgtcgtcagctcgtgtcgtgagatgttgggttaagtcccgcaacgagcgcaacccctatactatgttgccagcatttcggatgggaactcatagtagactgccgcggacaacgcggaggaaggcggggatgacgtcaagtcatcatgccccttacgtcttgggctacacacgtactacaatgggatgaacagagggaagcgaaatcgcgaggtggagcggatccctaaaagcatctctcagttcggattgtaggctgaaactcgcctacatgaagtcggaatcgctagtaatcgcaggtcagcatactgcggtgaatacgttcccgggccttgtacacaccgcccgtcacaccacgaaagtcattcacacccgaagccggctaagggcctatggtaccgaccgtctaaggtgggggcgatgattggggtgaagtcgtaacaaggtagccgtatcggaaggtgcggctggatcacctcctta

SEQ ID NO: 1199 - DNA, 1518 bp, Megamonas hypermegale
cctggctcaggacgaacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgagagatgaccgcatggatatttctctaaaggaggcctctgaaaatgcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgaagaaggtcttaggatcgtaaagttctgttgttaggggcgaagggcaacattttgaataagggtgttgtttgacggtacttaacgaggaagccacggctaactacgtgccagcagccgcggtaatacgtaggcggcaagcgttgtccggaattattgggcgtaaagggagcgcaggcgggaagttaagcggactttaaaagtgcggggctcaaccccgtgagggggtccgaactgactttcttgagtgcaggagagggaagcggaattcctagtgtagcggtgaaatgcgtagatattaggaagaacaccagtggcgaaggcggctttctggactgtaactgacgctgaggctcgaaagctagggtagcgaacgggattagataccccggtagtcctagccgtaaacgatggatactaggtgtgggaggtatcgaccccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacatcgactgacgtagttagagataagtatttttacttcggtaaacaggaagacaggtggtgcatggctgtcgtcagctcgtgtcgtgagatgttgggttaagtcccgcaacgagcgcaacccctatactatgttgccagcacgtaaaggtgggaactcatagtagactgccgcggacaacgcggaggaaggcggggatgacgtcaagtcatcatgccccttacgtcttgggctacacacgtactacaatgggatgaacagagggaagcgaagtcgcgaggcagagcggaaccctaaaagcatctctcagttcggattgcaggctgaaactcgcctgcatgaagtcggaatcgctagtaatcgcaggtcagcatactgcggtgaatacgttcccgggccttgtacacaccgcccgtcacaccacgaaagtcattcacacccgaagccggctaagggccgaaaggaaccgaccgtcgaaggtgggggcgatgattggggtgaagtcgtaacaaggtagccgtatcggaagg

SEQ ID NO: 1200 - DNA, 1530 bp, Megasphaera elsdenii
  modified_base (895)..(895): a, c, t, g, unknown or other
agagtttgatcctggctcaggacgaacgctggcggcgtgcttaacacatgcaagtcgaacgagaagagatgagaagcttgcttcttatcgattcgagtggcaaacgggtgagtaacgcgtaagcaacctgcccttcagatggggacaacagctggaaacggctgctaataccgaatacgttctttttgtcgcatggcagagagaagaaagggaggctcttcggagctttcgctgaaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggcgtacgacggtcaatacccgtcgtaagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggcggtaaacgatggatactaggtgtaggaggtatcgaccccttctgtgccggagttaacgcaataagtatcccngcctggggagtacggccgcaaaggctgaaactcaaaggaattgacgggggcccgcacaagcggtggagtatgtggtttaattcgacgcacgcgaagaaccttaccaagccttgacattgattgctatgggtagagatacccagttcctcttcggaggacaagaaaacaggtggtgcacggctgtcgtcagctcgtgtcgtgagatgttgggttaagtcccgcaacgagcgcaacccctatcttctgttaccagcgagttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccttttggagccagccgtcgaaggtgggggcgatgattggggtgaagtcgtaacaaggtaaccg

SEQ ID NO: 1201 - DNA, 1328 bp, Megasphaera genomosp. C1
gacgaacgctggcggcgtgcttaacacatgcaagtcgaacgagtggcaaacgggtgagtaacgcgtaaacaacctgccctacggatggggacaacagctggaaacggctgctaataccgaatacggaaagtcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgatgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctagagtatcggagaggaaagcggaattcctagtgtagcggtgaaatgcgtagatattaggaggaacaccagtggcgaaagcggctttctggacgaactgacgctgaggcgcgaaagccaggggagcgaacgggattagataccccggtggtcctggccgtaaacgatgggtactaggtgtaggagcttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattaacaggtggtgcacggctgtcgtcagctcgtgtcgtgagatgttgggttaagtcccgcaacgagcgcaacccctatcttctgttaccagcacgtggggactcaggagagactgccgcagacaatgcgggggaaggcggggatgacgtcaagtcatcatgccccttatggcttgggctacacacgtactacaatggctcttagagggaggcgaaggagcgatccggagcaaaccccaagagtctcagttcggatgtaggctgcaactcgcctacagaagcaggaatcgctagtaatcgcaggtcagcatactgcggtgaatacgttcccgggccttgtacacaccgcccgtcacaccacgaaagtcattcacacccgaagccggtaggtagccagccgtcgaaggtgggggcgatgattggggtgaagtcgtaacaaggtagccgtatcggaaggtgc

SEQ ID NO: 1202 - DNA, 1567 bp, Megasphaera genomosp. type_1
tggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttct

SEQ ID NO: 1203 - DNA, 1554 bp, Megasphaera micronuciformis
tggagagtttgatcctggctcaggacgaacgctggcggcgtgcttaacacatgcaagtcgaacgagagcgtagagaaagcttgctttttctacaatctagtggcaaacgggtgagtaacgcgtaaacaacctgccctacggatggggacaacagctggaaacggctgctaataccgaatacgttccgaaagtcgcatgactgtcggaagaaaggatggcctctatttataagctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaataatcttgtggttaatacccataagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctcagagtatcggagaggaaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaacggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctgg

SEQ ID NO: 1204 - DNA, 1419 bp, Megasphaera sp. BLPYG-07
atcctagagtttgatcatggctcaaggacgaacgctggcggcgtgcttaacaacatgcaagtcgaacgagaagagatgagaagcttgcttcttattgattcgagtggcaaacgggtgagtaacgcgtaagcaacctgccctctagatggggacaacagctggaaacggctgctaataccgaatacgttctttctgtcgcatggcagaaggaagaaagggaggctcttcggagctttcgctggaggaggggcttgcgtctgattagctagttggaggggtaacggcccaccaaggcgacgatcagtagccggtctgagaggatgaacgccacatggacacctgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggtcaatacccgtcgtaagtgacggtaccgtaagagaaagccacggctaactacggtgccagcagccgcgcgtaatacgtaggtggcaagcgttgtcggattattgggcgtaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgtggatactggtgtaggaggtatcgaccccttctgtgccggagttaacgcaataagtatcccgcctggggagtacggccgcaaggctgaaactcaaaaggaattgacgggggcccgcacaagcggtggagtatgtggtttaattcgacgcaacgcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcgggttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaacccgcctgcatgaagcaggaatcgctagtaatcgcaggtcagcaaaatacggtgaatacgttcccgggccttgtacaca

SEQ ID NO: 1205 - DNA, 1566 bp, Megasphaera sp. UPII 199-6
tggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttct

SEQ ID NO: 1206 - DNA, 1496 bp, Metallosphaera sedula
attccggttgatcctgccggacccgatcgctataggggtagggctaagccatgggagtcgtacgctctcgggaagagggcgtggcggacggctgagtaacacgtggctaacctgcccttgggatctggataaccccgggaaactggggctaatccggagcgggcaagggaatctggaatgatctcttgcctaaaagcctctcggctgatcccgtcgagaggcgcccaaggatggggctgcggcccatcaggctgttgggggagtaaaggtcccccaaaccgataacgggtaggggccgtgggagcgggagcccccagttgggcactgagacaagggcccaggccctacggggcgcaccaggcgcggaacgtccccaatgcgggaaaccgtgagggcgttacccctagtgccctcgcaagagggcttttctccactccagaaaggtggaggaataagcggggggcaagactggtgtcagccgccgcggtaataccagccccgcgagtgatcgggacgtttattgggcttaaagcgcccgtagccggcctgtaaagtcaccgtttaaagacccgggctcaactcggggaacggcggtgatacttacaggctagggggcgggagaggtcggaggtactcccggagtaggggcgaaatcctcagatcccgggaggaccaccagtggcgaaagcgtccggctagaacgcgcccgacggtgaggggcgaaagccggggtagcaaataggattagataccctagtagtcccggctgtagacgatgcaggctaggtgtcgcgtaggctttgtgcctgcgcggtgccgcaggaaaactggtaagcccgccgcctggggagtacggccgcaaggctgaaacttaaaggaattggcgggggagcaccacaaggggtggaacctgcggctcaattggagtcaacgcctggaatctcaccgggggagaccgcaggatgacggccaggctaacgaccttgccagactcgcggagaggaggtgcatggccgtcgccagctcgtgttgtgaaatgtccggttaagtccggcaacgagcgagacccccacttctagttggtaaccgtctctccggagacggtccacactagaaggactgccggtgttaaaccggaggaaggagggggccacggcaggtcagcatgccccgaaacttccgggccgcacgcgggttacaatggcagggacagcgggatccgaccccgagaggggaaggcaatcccgcaaaccctgcctcagttgggatcgagggctgaaactcgccctcgtgaacgaggaatccctagtaaccgcgggtcaacaacccgcggtgaatacgtccctgctccttgcacacaccgcccgtcgctccacccgagtggaggggaagtgaggcctcttgcccctcggggtgggaggtcgagcttctcctccgcgaggggggagaagtcgtaacaaggtagccgtaggggaacctgcggctggatcacctca

SEQ ID NO: 1207 - DNA, 1376 bp, Methanobacterium formicicum
  modified_base (619)..(619): a, c, t, g, unknown or other
gattaagccatgcaagtcgaacgatccttcggggtcgtggcgtacggctcagtaacacgtggataacctaaccttaggactgggataaccctgggaaactggggataataccggatatgtagggctgcctggaatggttccctattgaaatgttccgacgcctaaggatggatctgcggcagattaggtagttggcggggtaaatgcccaccaagccagtaatctgtacgggttgtgagagcaagagcccggagatggaacctgagacaaggttccaggccctacggggcgcagcaggcgcgaaacctccgcaatgcacgaaagtgcgacgggggaaacccaagtgccactcttaacggggtggcttttcttaagtgtaaaaagcttttggaataagagctgggcaagaccggtgccagccgccgcggtaacaccggcagctcaagtggtggccgtttttattgggcctaaagcgttcgtagccggcttgataagtctctggtgaaatctcacggcttaaccgtgagaattgctggagatactattaggcttgaggccgggagaggttagcggtactcccggggtaggggtgaaatcctataatcccgggaggaccacntgtggcgaaggcggctaactggaacgggcctgacggtgagtaacgaaagccaggggcgcgaaccggattagatacccgggtagtcctggccgtaaacgatgtggacttggtgttgggatggctccgagctgccccagtgccgaagggaagctgttaagtccaccgcctgggaagtacggtcgcaagactgaaacttaaaggaattggcgggggagcaccacaacgcgtggagcctgcggtttaattggattcaacgccggacatctcaccaggggcgacagcagaatgatagccaggttgatgaccttgcttgacaagctgagaggaggtgcatggccgccgtcagctcgtaccgtgaggcgtcctgttaagtcaggcaacgagcgagacccacgcccttagttaccagcggatccttcgggatgccgggcacactaaggggaccgccagtgataaactggaggaaggagtggacgacggtaggtccgtatgccccgaatcccctgggctacacgcgggctacaatggttaggacaatgggttccgacactgaaaggtggaggtaatctcctaaacctggccttagttcggattgagggctgtaactcgccctcatgaagctggaatgcgtagtaatcgcgtgtcataaccgcgcggtgaatacgtccctgctccttgcacacaccgcccgtcacgccacccaaaaagggtttggatgaggccatagtctttggttatggtcgaatctaggttcttt

SEQ ID NO: 1208 - DNA, 1359 bp, Methanobrevibacter acididurans
  modified_base (988)..(988): a, c, t, g, unknown or other
gatttctgtttgatcctggcagaagctactgctattgggattcgattaagccatgcaagtcgaaagaatttatattcttggcgtacggctcagtaacacgtggataacctacccttaggactgggataactctgggaaactggagataatactggatagatgatttttcctgtaattggtattttgttgaaatgttttttcgcctaaggatgggtctgcggccgattaggtagttggtgaggtaatggcttaccaagccgtttatcggtacgggttgtgagagcaagagcccggagatggaacctgagacaaggttccaggccctacggggcgcagcaggcgctaaacctccgcaatgtgagcaatcgcgacggggggatcccaagtgccattcttaacgggatggcttttcttaagtgtaaagagcttttggaataagagctgggcaagaccggtgccagccgccgcggtaacacccggcagctctagtggtagctgtttttattgggcctaaagcgttcgtagccggtttaataagtctttggtgaaatcctgttttttaactatgggaattgctgaggatactgttaggcttgaggtcgggagaggttagcggtactcccagggtaggggtgaaatcctgtaatcctgggaggaccacctgtggcgaaggcggctaactggaacgaacctgacggtgagggacgaaagctaggggcgcgaaccggattagatacccgggtagtcctagccgtaaacgatgcggactgggtgttgggatggctttgagctgtttcggtgccgaagggaagctgttaagtccgccgcctgggaagtacggtcgcaagactgaaacttaaaggaattggcgggggagcaccacaacgcgtggagcctgcggtttaattggattcaacgccggagatctcaccaggggcgacagcagtatgatggccaggttgatggccttgcttgacaagctgaagangaggtgcatggcccgccgtcagctcgtaccgtgaggagtcctgttaagtcaggcaacgagcgagaccccacgctcttagttaccagcgggatccttttttggatgccgggcacactaaggggaccgccagtgataaactggaggaaggagtggacgacggtaggtccgtatgccccgaatcccctgggctacacgcgggctacaatggctgagacaatgggttacgacgctgaaaagcggagttaatcctctaaacttagtcgtagttcggattgagggctgtaactcgccctcatgaagctggaatgcgtagtaatcgcgtgtcacaatcgcgcggtgaatacgtccctgctccttgcacacaccgcccg

SEQ ID NO: 1209 - DNA, 1268 bp, Methanobrevibacter arboriphilus
gctcagtaacacgtggataacctacccttaggactgggataaccctgggaaactggggctaatactggatagatggtttttttcctgtaatggtatttcgtctaaatgttttttttcgcctaaggatgggtctgcggccgattaggttgttggttaggtaatggcttaccaagccgtttatcggtacgggttgtgagagcaagagcccggagatggaacctgagacaaggttccaggccctacggggcgcagcaggcgcgaaacctccgcaatgtgagaaatcgcgacggggggaccccaagtgccattcttaacgggatggcttttcttaagtgtaaaaagcttttggaataagagctgggcaagaccggtgccagccgccgcggtaacaccggcagctctagtggtggccagttttattgggcctaaagcgttcgtagccggtttattaagtctctggtgaaatcccgtagcttaactatgggaattgctggagatactagtagacttgaggtcgggagaggttagaggtactcccagggtaggggtgaaatcctgtaatcctgggaggaccacctgtggcgaaggcgtctaactggaacgaacctgacggtgagggacgaaagctaggggcgcgaaccggattagatacccgggtagtcctagccgtaaacgatgcggacttggtgttagaatggctttgagccgctctagtgccgaagggaagctgttaagtccgtcgcctgggaagtacggtcgcaagactgaaacttaaaggaattggcgggggagcaccacaacgcgtggagcctgcggtttaattggattcaacgccggacatctcaccaggggcgacagcagtatgatggccaggttgatggccttgcttgacaagctgagaggaggtgcatggccgccgtcagctcgtaccgtgaggcgtcctgttaagtcaggcaacgagcgagacccacgcccttagttaccagcggatccttttttttggatgccgggcacactaaggggaccgccagtgataaattggaggaaggagtggacgacggtaggtccgtatgccccgaatcccctgggcaacacgcgggctacaatggctgagacaatgggttccgacattgaaaagtggaggtaatcctctaaacttagtcgtagttcggattgagggctgtaactcgccctcatgaagctggaatgcgtagtaatcgcgtgtcataatcgcgcggtgaatacgtccctgctccttgcacacaccg

SEQ ID NO: 1210 - DNA, 1364 bp, Methanobrevibacter curvatus
  modified_base (1272)..(1272): a, c, t, g, unknown or other
  modified_base (1289)..(1289): a, c, t, g, unknown or other
atttatttcgtggcgtacggctcagtaacacgtggataacctacccttaggactaggataaccctgggaaactggggctaatactggataggtgatttttcctgcaatggtatttcatttaaatgttcttatgttcgcctaaggatgggtctgcggccgattaggttgttggtggggtaatggcttaccaagccgattatcggtacgggttgtgagagcaagagcccggagatggaacctgagacaaggttccaggccctacggggcgcagcaggcgcgaaacctccgcaatgtgagcaatcgcgacggggggatcccaagtgccattcttaaaagggatggcttttcataagtgtaaaaagcttttggaataagagctggcaagaccggtgccagccgccgcggtaacaccggcagctctagtggtagccatttttattgggcctaaagcgttcgtagccggtttaataagtctttggtgaaagcctacagcttagctgtgggaattgctggagatactattagacttgaggtcgggagaggttagaggtactcccagggtaggggtgaaatcctgtaatcctgggaggaccacctgtggcgaaggcgtctaactggaacgaacctgacggtgagggacgagagctaggggcgcgagccggattagatacccgggcagtcctagccgtaaacgatgtggacttggtgttgggatggctttgagctgtttcagtgccgaagggaagctgttaagtccaccgcctgggaagtacggtcgcaagactgaaacttaaaggaattggcgggggagcaccacaacgcgtggagcctgcggtttaattggattctacgccggacatctcaccaggggcgacagcagtatgatggccaggttgatggtcttgcttgacaagctgagaggaggtgcatggccgccgtcagctcgtaccgtgaggcgtcctgttaagtcaggcaacgagcgagacccacgcccttagttaccagcggatccttcgggatgccgggcacactaaggggaccgccagtgataaactggaggaaggagtggacgacggtaggtccgtatgccccgaatcccctgggcaacacgcgggctacaatggctaagacaatgagttccgccactggaaagtgaaggtaatctcctaaacttagtcgtagtacggattgagggctgtaactcgccctcatgaagctggaatgcgtagtaatcgcgtgtcataatcgcgcggtgaatacgtccctgctccntgcacacaccgcccgtnacaccacccaaaaagggctgggatgaggctttgatcttaggttaaattcgaatctcggttttttgaggagggtga

SEQ ID NO: 1211 - DNA, 1314 bp, Methanobrevibacter cuticularis
  modified_base (431)..(431): a, c, t, g, unknown or other
  modified_base (966)..(966): a, c, t, g, unknown or other
aggctactgctattggggttcgaataagccatgcaagtcgaacgaatttatattcgtggcatacggctcagtaacacgtggataacctacccttaggactagaataaccctgggaaactggggctaatactggatagatgatttttcctgcaatggtatttcgtttaaatgttttttcgcctaaggatgggtctgcggccgaataggtagttggttaggtaatggcttaccaagccgcttatcggtacgggttgtgagagcaagagcccggagatggaacctgagacaaggttccaggccctacggggcgcagcaggcgcgaaacctccgcaatgtgagaaatcgcgacggggggaccccaagtgccattcttaacgggatggcatttgtgaggtgtaaaaagcttcaagaataagagctgggcaagaccnggtgccagccgccgcggtaacaccggcagctctagtggtagccatttttattgggcctaaagcgttcgtagccggtttaataagtctctggtgaaatcctgtagcttaactattggaattgctggagatactattagacttgaggtcgggagaggttagaggtactcccagggtaggggtgaaatcctgtaatcctgggaggaccacctgtggcgaaggcgtctaactggaacgaacctgacggtgagggacgaaagctaggggcgcgaaccgggttagatacccgggtagtcctagccgtaagcgatgcggacttggtgttggaatggctttgagccgctccagtgccgaagggaagctgttaagtccgccgcctgggaagtacggtcgcaagactgaaacttaaaggaattggcgggggagcactcaacgcgtggagcctgcggtttaattggattcaacgccggacatctcaccaggggcgacagcagtatgatggccaggttgatggccttgcttgacaagctgagaggangtgcatggccgccgtcagctcgtaccgtgaggcgtcctgttaagtcgggcaacgagcgagacccacgcccttagttaccagcggatccttttggatgccgggcacactaaggggaccgccagtgataaactggaggaaggagtggacgacggtaggtccgtatgccccgaatcccctgggcaacacgcgggctacaatggctaagacaatgggttccgacactggaaagtggaggtaatcctctaaacttagtcgtagttcggattgagggctgtaacccgcccccatgaagctggaatgcgtagtaatcgcgtgtcataatcgcgcggtgaatacgtccctgctcct

SEQ ID NO: 1212 - DNA, 1363 bp, Methanobrevibacter filiformis
  modified_base (1017)..(1017): a, c, t, g, unknown or other
aatttatattcgtggcgtacggctcagtaacacgtggataacctacccttaggaccaggataactctggaaactggagctaatactggataggcgatttttcctgcaattggtatttcgtttaaatgttttttcgcctgaggatgggtctgcgttcgattagattgttggtaaggtaatggcttaccaagtcgattatcggtacgggttgtgagagcaagagcctggagatggaacctgagacaaggttccaggccctacggggcgcagcaggcgcgaaacctccgcaatgtgagaaatcgcgacggggggaccccaagwgccattcttaacgggatggcttttcttaagtgtaaaaagcttttggaataagagctgggcaagaccgggccagccgccgcggtaacaccggcagctctagtggtagccatttttattgggcctaaagcgttcgtagctggtttaataagtctttggtgaaatcctatagcttaactgtgggaattgctggggatactattagacttgaggtcgggagaggttagcggtactctcagggtaggggtgaaatcctgtaatcctgagaggaccacctgtggcgaaggcggctaactggaacgaacctgacggtgagggacgaaagccaggggcgcgaaccggattagatacccgggtagtcctggccgtaaacgatgcggacttggtgttaggatggtcttgagccgttctagtgccgaagggaagctgttaagtccgccgcctgggaagtacggtcgcaagactgaaacttaaaggaattggcgggggagcaccacaacgcgtggagcctgcggtttaattggattcaacgccggacatctcaccaggggcgacagccgtatgatagccaggttgatgatcttgcttgacaagctgagaggaggtgcatggccgccgtcagctcgtaccgtgaggcgtcctgttaagtcaggcaacgagcgagacccacgcccttagttaccaacagatcctttattgnatgctgggcacactaaggggaccgccagtgataaactggaggaaggagtggacgacggtaggtccgtatgccccgaatcccctgggcaacacgcgggctacaatggctaagacaatgggttccgacattgaaaagtggaggtaatcccctaaacttggtcgtagttcggattgagggctgtaactcgccctcatgaagctggaatgcgtagtaatcgcgtgtcataatcgcgcggtgaatacgtccctgctccttgcgcacaccgcccgtcacaccacccaaaaagggcttggatgaggctttaatctttggttaaattcgaatctaggttttttgaggagggtga

SEQ ID NO: 1213 - DNA, 1328 bp, Methanobrevibacter gottschalkii
tgctactgctattgggattcgattaagccatgcaagtcgaacgagtttaggctcgtggcgtacggctcagtaacacgtggataacctacccttaggactgggataaccttgggaaactgaggataatactggataggcaatttttcctgtaatggttttttgtttaaatgttttttcgcctaaggatgggtctgcggccgattaggtagttggttaggtaatggcttaccaagcctttgatcggtacgggttgtgggagcaagagcccggagatggaacctgagacaaggttccaggccctacggggtgcagcaggcgcgaaacctccgcaatgtgagaaatcgcgacggggggatcccaagtgctattcttaacgggatagcttttctttagtgtaaagagcttttggaataagagctgggcaagaccggtgccagccgccgcggtaacaccggcagctctagtggtagcagtttttattgggcctaaagcgtccgtagccggtttaataagtctctggtgaaatcctgtagcttaactatgggaattgctggagatactattggacttgagaccgggagaggttagaggtactcccagggtagaggtgaaattctgtaatcctgggaggaccgcctgttgcgaaggcgtctgactggaacggttctgccggtgagggacgaaagttaggggcgcgaaccggattagatacccgggtagtcctaactgtaaacgatgcggacttggtgttggggtggctttgagctgcttcagtgccgaagggaagctgttaagtccgccgcctgggaagtacggtcgcgagactgatacttaraagaattggcgggggagcaccacaacacgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgcccttagttaccagcttgtcctttttttggatgatagggcacactaaggggaccgcctatgataaataggaggaaggagtggacgacggtaggtccgtatgccccgaatcctctgggcaacacgcgggctacaatggctgggacaatgggttccgacaccgaaaggtggaggtaatcctctaaacttagtcgtagttcggattgaggactgtaactcgttctcatgaagctggaatgcgtagtaatcgcgtatcactattgcgcggtgaatacgtcccttggtccttgcacacacc

SEQ ID NO: 1214 - DNA, 1262 bp, Methanobrevibacter millerae
gctcagtaacacgtggataacctacccttaggaccgggataaccttgggaaactgaggataatactggataggcaattattcctggaatggttttttgtttaaatgttttttcgcctaaggatgggtctgcggccgattaggtagttggttaggtaacggcttaccaagccattgatcggtacgggttgtgagagcaagagcccggagatggaacctgagacaaggttccaggccctacggggtgcagcaggcgcgaaacctccgcaatgtgagaaatcgcgacggggggatcccaagtgccattcttaacgggatggcttttcattagtgtaaagagcttttggaataagggctgggcaagaccggtgccagccgccgcggtaacaccggcagctctagtggtagcagtttttattgggcctaaagcgtccgtagccggtttaataagtctctggtgaaatcctgtagcttaactgtgggaattgctggagatactattagacttgagaccgggagaggttagaggtactcccagggtagaggtgaaattctgtaatcctgggaggaccgcctgttgcgaaggcgtctaactggaacggttctgacggtgagggacgaaagttaggggcgcgaaccggattagatacccgggtagtcctaaccgtaaacgatgcggacttggtgttggggtggctttgagctgctccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatggccaagctgatgactttgcttgactagctgagaggaggtgcatggccgccgtcagctcgtaccgtgaggcgtcctgttaagtcaggcaacgagcgagacccacgcccttagttaccagcggatccttttttggatgccgggcacactaaggggaccgcctatgataaataggaggaaggagtggacgacggtaggtccgtatgccccgaatcctctgggcaacacgcgggctacaatggctgagacaatgggttccgacaccgaaaggtggaggtaatcctctaaacttagtcgtagttcggattgaggactgtaactcgttctcatgaagctggaatgcgtagtaatcgcgtatcactattgcgcggtgaatacgttcctgctccttgcacacaccg

SEQ ID NO: 1215 - DNA, 1266 bp, Methanobrevibacter olleyae
tgctcagtaacacgtggataacctacccttaggactgggataaccctgggaaactggggctaataccggatagatgatttttttcctgtaatggtgttttgtttaaatgtttttttttcgcctaaggatgggtctgcggcagattaggtagttggttgggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcttaagtgtaaaaagcttttggaataagagctgggcaagaccggtgccagccgccgcggtaacaccggcagctctagtggtagctgtttttattgggcctaaagcgttcgtagccggtttggtaagtcactggtgaaatcctgtagcttaactatgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagctaggggcgcgaaccggattagatacccgggtagtcctagccgtaaacgatgcggacttggtgttgggatggctttgagccgctccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagaccacgcccttagttaccatcagattctttggaatgctgggcacactaaggggaccgccagtgataaattggaggaaggagtggacgacggtaggtccgtatgccccgaatcccctgggctacacgcgggctacaatggctgggacaatgggttccgacgccgaaaggtggaggtaatcttttaaacctagtcgtagttcggattgagggctgtaactcgccctcatgaagctggaatgcgtagtaatcgcgtgtcacaatcgcgcggtgaatacgtccctgctccttgcacacaccga

SEQ ID NO: 1216 - DNA, 1475 bp, Methanobrevibacter oralis
ccggttgatcctgccagatgctactgcyattgggattcgattaagccatgcaagtcgaacgagtttagactcgtggcgtacggctcagtaacacgtggataacctacccttaggactgggataaccctgggaaactggggataatactggataggcaattagtcctgtaatggttttttgtttaaatgttttttcgcctaaggatgggtctgcggccgattaggtagttggttaggtaatggcttaccaagccgttgatcggtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagttctagtggtagcagttattattgggcctaaagcgtccgtagccggtttaataagtctctggtgaaatcctgtagcttaactatgggaattgctggagatactattagacttgagatcgggagaggttagaggtactcccagggtagaggtgaaattctgtaatcctgggaggaccgcctgttgcgaaggcgtctaactggaacgattctgacggtgagggacgaaagttaggggcgcgaaccggattagatacccgggtagtcctaactgtaaacgatgcggacttggtgttgggatggctttgagctgtctcagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgcccttagttaccagcggattcttttttttgaagccgggcacactagggggaccgcctatgataaataggaggaaggagtggacgacggtaggtccgtatgccccgaatccacagggyaacacgcgggctacaatggctgagacaatgggttccgacaccgaaaggtggaggtaatcctctaaacttagtcgtagtccggattgaggactgtaactcgttctcatgaagctggaatgcgtagtaatcgcgtgtcacaatcgcgcggtgaatacgtccctgctccttgcacacaccgcccgtcacgccacccaaaaagggattggatgaggatgtaatgttttttgttatattcgaatctagtttttttaaggagggcgaagtcgtaacaaggtacggctaggggaacctgcggctggatcacctcc

SEQ ID NO: 1217 - DNA, 1260 bp, Methanobrevibacter ruminantium
gctcagtaacacgtggataacctacccttaggactgggataaccctgggaaactggggctaataccggatagataatttttcctggaatggtattttgtttaaatgttttttcgcctaaggatgggtctgcggcagattaggtagttggttaggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcttaagtgtaaaaagcttttggaataagagctgggcaagaccggtgccagccgccgcggtaacaccggcagctctagtggtagctacttttattgggcctaaagcgttcgtagccggtttgataagtcactggtgaaatcctatagcttaactgtgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagccaggggcgcgaaccggattagatacccgggtagtcctggccgtaaacgatgcggacttggtgttgggatggctttgagccgctccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagacccacgcccttagttaccatcagattctccggaatgctgggcacactaaggggaccgccagtgataaactggaggaaggagtggacgacggtaggtccgtatgccccgaatcccctgggctacacgcgggctacaatggctgggacaatgggttccgacgccgaaaggcgaaggcaatcttttaaacctagtcgtagttcggattgagggctgtaactcgccctcatgaagctggaatgcgtagtaatcgcgtgtcacaatcgcgcggtgaatacgtccctgctccttgcacacaccg

SEQ ID NO: 1218 - DNA, 1485 bp, Methanobrevibacter smithii
ttcaattctgtttgatcctggcagatgctactgctattgggattcgattaagccatgcaagtcgaacgagtttaggctcgtggcgtacggctcagtaacacgtggataacctacccttaggactgggataaccctgggaaactggggataatactggataggcaattattcctgtaatggttttttgtttaaatgttttttcgcctaaggatgggtctgcggccgattaggtagttggttaggtaatggcttaccaagcctttgatcggtacgggttgtgagagcaagagcccggagatggaacctgagacaaggttccaggccctacggggtgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagctctagtggtagcagtttttattgggcctaaagcgtccgtagccggtttaataagtctctggtgaaatcctgcagcttaactgtgggaattgctggagatactattagacttgagatcgggagaggttagaggtactcccagggtagaggtgaaattctgtaatcctgggaggaccgcctgttgcgaaggcgtctgactggaacgattctgacggtgagggacgaaagctaggggcgcgaaccggattagatacccgggtagtcctagctgtaaacgatgcggacttggtgttggggtggctttgagctgtcccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatagccaggttgatgactttgcttgactagctgagaggaggtgcatggccgccgtcagctcgtaccgtgaggcgtcctgttaagtcaggcaacgagcgagacccacgctcttagttaccagcggatccttttttggatgccgggcacactaaggggaccgcctatgataaataggaggaaggagtggacgacggtaggtccgtatgccccgaatcctctgggcaacacgcgggctacaatggctgagacaatgggttccgacgccgaaaggcggaggtaatcctctaaacttagtcgtagttcggattgaggactgtaactcgttctcatgaagctggaatgcgtagtaatcgcgtgtcacaatcgcgcggtgaatacgtccctgctccttgcacacaccgcccgtcacgccacccaaaaagggattggatgaggatgtaatgttttgttatattcgaatctagtttttttaaggagggcgaagtcgtaacaaggtagccgtaggggaacctgcggctggatcacctccttacac

SEQ ID NO: 1219 - DNA, 1268 bp, Methanobrevibacter thaueri
  modified_base (6)..(8): a, c, t, g, unknown or other
  modified_base (607)..(607): a, c, t, g, unknown or other
  modified_base (610)..(611): a, c, t, g, unknown or other
  modified_base (868)..(868): a, c, t, g, unknown or other
  modified_base (1124)..(1124): a, c, t, g, unknown or other
  modified_base (1255)..(1255): a, c, t, g, unknown or other
  modified_base (1258)..(1258): a, c, t, g, unknown or other
aagccnnncaagtcgaacgaatttagattcgtggcgtacggctcagtaacacgtggataacctacccttaggaccgggataaccttgggaaactgaggataatactggataggcaatttttcctgtaatggttttttgtttaaatgttttttcgcctaaggatgggtctgcggccgattaggtagttggttaggtaatggcttaccaagccgttgatcrgaacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccggtgccagccgccgcggtaacaccggcagctctagtggtaacaatttttattgggcctaaagcgtccgtagccggtttaataagtctctggtgaaatcctgtagcttaactgtgggaattgctggagatactattagacttgagaccgggagaggttagaggtactcccagggtagaggtgaaattctgtaatcctgggagnacnncctgttgcgaaggcgtctaactggaacggttctgacggtgagggacgaaagttaggggcgcgaaccggattagatacccgggtagtcctaactgtaaacgatgcggacttggtgttggggtggctttgagctgctccagtgccgaagggaagctgttaagtccgccgcctgggaagtacggtcgcaagactgaaacttaaaggaattggcgggggagcaccacaacgcgtggagcctgcggtttaattggattcaangccggacatctcaccagaggcgacagctgtatgatagccaggytgatgactttgcttgactagctgagaggaggtgcatggccgccgtcagctcgtaccgtgaggcgtcccgttaagtcaggcaacgagcgagacccacgcccttagttaccagcttatcccctcggggatgatgggcacactaaggggaccgcctatgataaataggaggaaggagtggacgacggtaggtccgtatgccccgaatcctctgggnaacacgcgggctacaatggctgagacaatgggttccgacaccgaaaggtggaggtaatcctctaaacttagtcgtagttcggattgaggactgtaactcgttctcatgaagctggaatgcgtagtaatcgngtntcaccattgc

SEQ ID NO: 1220 - DNA, 1335 bp, Methanobrevibacter woesei
  modified_base (32)..(32): a, c, t, g, unknown or other
tgctactgctattgggattcgattaagccatncaagttgaacgaatttagattcgtggcgtacggctcagtaacacgtggataacctacccttaggactgggataactctgggaaactggggataataccggataggcaatttttcctgtaatggttttttgtttaaatgttttttttcgcctaaggatgggtctgcggcagattaggtagttggttaggtaatggcttaccaagccgttgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcattagtgtaaagagcttttggaataagagctgggcaagaccgttgccaaccgccgcggtaacaccgtcagctctagtggtagcagtttttattgggcctaaagcgtccgtagccggtttattaagtctctggtgaaatcctgtagcttaactgtgggaattgctggagatactagtagacttgagatcgggagaggttagaggtactcccagggtagaggtgaaattctgtaatcctgggaggaccgcctgtggcgaaggcgtctagctggaacgattctgccggtgagggacgaaagctaggggcgcgaaccggattagatacccgggtagtcctagctgtaaacgatgcggacttggtgttgggatggctttgagctgctccagtgccgaagggaagctgttaagtccgccgcctgggaagtacggtcgcaagactgaaacttaaaggaattggcgggggagcaccacaacgcgtggagcctgcggtttaattggattcaacgccggacatctcaccagaggcgacagctgtatgatgaccagtttgatgagcttgtttgactagctgagaggaggtgcatggccgccgtcagctcgtaccgtgaggcgtcctgttaagtcaggcaacgagcgagacccacgcccttagttaccagcggattctagtgaatgccgggcacactagggggaccgcctgtgataaataggaggaaggagtggacgacggtaggtccgtatgccccgaatcctctgggcaacacgcgggctacaatggatgagacaatgggttccgacgccgaaaggtggaggtaatcctctaaacttattcgtagttcggattgaggactgtaactcgttctcatgaagctggaatgcgtagtaatcgcgtgtcataatcgcgcggtgaatacgtccctgctccttggacacaccgcccgtcacg

SEQ ID NO: 1221 - DNA, 1366 bp, Methanobrevibacter wolinii
  modified_base (27)..(27): a, c, t, g, unknown or other
agctactgctattgggattcgattaanccatacaagatgaacgaactttttggttcgtggcgtacggctcagtaacacgtggataacctacccttaggactgggataactccgggaaactggggataatactggataggcaatttttcctgtaatggttttttgtttaaatgttttttcgcctaaggatgggtctgcggcagattaggttgttggttgggtaatggcttaccaagcctataatctgtacgggttgtgagagcaagagcccggagatggaacctgagacaaggttccaggccctacggggcgcagcaggcgcgaaacctccgcaatgtgagaaatcgcgacggggggatcccaagtgctattcttaacggggtagcttttcttaagtgtaaagagcttttggaataagagctgggcaagaccggtgccagccgccgcggtaacaccggcagctctagtggtagctgtttttattgggcctgaagcgttcgtagccggtttgataagtctctggtgaaatcttgtagcttaactgtgggaattgctggagatactattaggcttgagatcgggagaggtcagaggtactcctggggtaggggtgaaatcctgtaatcctaggaggaccacctgtggcgaaggcgtctgactagaacgattctgacggtgaggaacgaaagctaggggcgcgaaccggattagatacccgggtagtcctagccgtaaactatgcggacttggtgtgagggtggctttgagccgtcctggtgccgaagggaagctgttaagtccgccgcctgggaagtacggtcgcaagactgaaacttaaaggaattgtcgggggagcaccacaacgcgtggagcctgcggtttaattggattcaacgccggagatctcaccagcggcgacagcagtatgattatcaggctgatgaccttatttgacaagctgagaggaggtgcatggccgccgtcatctcgtgccgtgaggcgtcctgttaagtcaggcaacgagcgagacccacgctcttagttaccagcatgttactttggtaatgatggggacactaaggggaccgccagtgataaattggaggaaggagtggacgacggtaggtccgtatgccccgaatccgctgggctacacgcgggctacaatggcagagacaatgggttccgacgctgaaaagcggtggtaatcttttaaactttgtcgtagttcggattgagggctgtaactcgtcctcatgaagctggaatgcgtagtaatcgcgtgtcataatcgcgcggtgaatacgtccctgctccttggacacaccgaccgtcacgccacccaaaaagggcttggttgaggcttt

SEQ ID NO: 1222 - DNA, 1261 bp, Methanosphaera stadtmanae
gctcagtaacacgtggataacttacccttaggaccgggataactttgggaaactgaagataatactggatattaggttatgcctggaatggtttacctttgaaatgtatttttcgcctaaggatagatctgcggctgattaggtcgttggtggggtaatggcccaccaagccgatgatcggtacgggttgtgagagcaagagcccggagatggaacctgagacaaggttccagaccctacggggtgcagcaggcgcgaaacctccgcaatgtacgcaagtgcgacggggggatcccaagtgttattcttaacagaataacttttcattagtgtaaaaagcttttagaataagagctgggcaagaccggtgccagccgccgcggtaacaccggcagctcaagtggtagctgtttttattgggcctaaagcgttcgtagccggtttgataagtctttggtgaaagcttgtagcttaactataagaattgctgaagatactgtcagacttgaagtcgggagaggttagaggtactaccggggtaggggtgaaatcctataatcctgggaggaccacctgtggcgaaggcgtctaactggaacgatcttgacggtgagtaacgaaagccaggggcgcgaaccggattagatacccgggtagtcctggccgtaaacgatgtggacttggtgttggaatggcctcgagttgttccggtgccgaagggaagctgttaagtccaccgcctgggaagtacggtcgcaagactgaaacttaaaggaattggcgggggagcaccacaacgcgtggagcctgcggtttaattggattcaacgccggacatctcaccaggagcgacagcagaatgataatcaggttgatgaccttatttgactagctgagaggaggtgcatggccgccgtcagctcgtactgtgaagcgtcctgttaagtcaggcaacgagcgagacccacgcccttagttaccaacacaatctctggattggtgggcacactagggggaccgccagtgataaactggaggaaggagtggacgacggtaggtccgtatgccccgaatctcctgggctacacgcgggctacaatggctatggcaatgggtttctgcactgaaaagtgatggtaatctcctaaacatagtcttagttcggattgagggctgtaactcgccctcatgaagctggaatgcgtagtaatcgcatgtcacaaccgtgcggtgaatacgtccctgctccttgcacacaccg

SEQ ID NO: 1223 - DNA, 1347 bp, Methylobacterium extorquens
ccttagagtttgatcctggctcagagcgaactcttgcggcaggcttaacacatgcaagtcgaacgggcttcttcggaagtcagtggcagacgggtgagtaacacgtgggaacgtgcccttcggttcggaataactcagggaaacttgagctaataccggatacgcccttttggggaaaggttgactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttaccccgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgcaaaaaccgcccgtc

SEQ ID NO: 1224 - DNA, 1335 bp, Methylobacterium podarium
tgagtttgatcatggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacaggattagataccctggtagtccacgccgtaaacgatgaatgccagccgttggtcggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgccatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagagggaggcgaaggggcgacctggagcaaatcccggccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1225 - DNA, 1516 bp, Methylobacterium radiotolerans
agagtttgatcctggctcaggctggaacacctcctcagagtttgatcatggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgccctttttggggaaaggtttactgccggaagatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcgaggaggcaggcgaccacggtagggtcagcgactggggtgaagtcgtaacaaggtagccgtaggggaacctgcggctggatcacctccttagag

SEQ ID NO: 1226 - DNA, 1334 bp, Methylobacterium sp. 1sub
gagtttgatcctggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaaggggacagcggaactgcgagtgtagaggtgaaattcgtagatattcgcaagaacaccagtggcgaaggcggctgtctggtccgtctgacgctgaggcgcgaaagcgtggggagcaaacgggattagataccctggtagtccacgccgtaaacgatgaatgccagccgctggccggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagtgggacgcgaaaccgcgaggttgagcaaatccccgccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1227 - DNA, 1334 bp, Methylobacterium sp. MM4
gagtttgatcatggctcagagcgaacgctggcggcaggcttaacacatgcaagtcgaacgagtggcagacgggtgagtaacacgtgggaacgtgcccttcggttcggaataactcagggaaacttgagctaataccggatacggaaagctgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacaggattagataccctggtagtccacgccgtaaacgatgaatgccagccgttggccggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatgcacaggtgctgcatggctgtcgtcagctcgtgtcgtgagatgttgggttaagtcccgcaacgagcgcaacccacgtccttagttgccatcatgggcactctagggagactgccggtgataagccggaggaaggtgtggatgacgtcaagtcctcatggcccttacgggatgggctacacacgtgctacaatggcggtcagtgggacgcgaaaccgcgaggttgagcgaatccccgccgtctcagttcggatgcactctgcaactcgggtgcagaaggcggaatcgctagtaatcgtggatcagcacgccacggtgaatacgttcccgggccttgtacacaccgcccgtcacaccatgggagttggtcttacccgacggcgctcgccaggcaggcgaccacggtagggtcagcgactggggtgaagtcgtaacaaggtaaccgta

SEQ ID NO: 1228 - DNA, 1475 bp, Methylocella silvestris
agagtttgatcctggctcagaacgaacgctggcggcaggcctaacacatgcaagtcgaacgctgtagcaatacagagtggcagacgggtgagtaacacgtgggaacatacccttcggttcggaacaactcagggaaacttgagctaataccggatacgccctttgggggaaagatttatcgccgaaggattggcccgcgtctgattagctagttggcggggtaatggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggggatctcgagtccgggagaggtgagcggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtccggtttggtttccagagatggattccttcagttaggctggccggaacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacagtgggatgctaaggggcgacccctcgcaaatctcaaaaagccgtctcagttcggattgcgctctgcaactcgagcgcatgaaggtggaatcgctagtaatcgtagatcagaacgctacggtgaatacgttcccgggccttgtacacaccgcccgtcacaccatgggagttggttctacccgaaggcgttttcttaaccgcaaggagagaggcgaccacggtagggtcagcgactggggtgaagtcgtaacaaggtagccgtaggggaacctgcggctggatcacct

SEQ ID NO: 1229 - DNA, 1351 bp, Methylophilus sp. ECd5
  modified_base (77)..(77): a, c, t, g, unknown or other
  modified_base (1012)..(1012): a, c, t, g, unknown or other
tggcggaatgctttacacatgcaagtcgaacggcagcacgggagcttgctcctggtggcgagtggcgaacgggtgantaatatatcggaacgtatccaataatgggggataactaatcgaaaggttggctaataccgcatacgccctacgggggaaagctagggaccttcgggcctggcgttaatggagcggccgatatctgattagctagttggtgaggtaaaagctcaccaaggcgacgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaagattatcctctaacataggatgattatgacggtaccttgataagaagcaccggctaactacgtgccagcagccgcggtaatacgtagggtgcgagcgttaatcggaattactgggcgtaaagcgtgcgcaggctgttttgtaagtcagatgtgaaatccctgagctcaacttaggaactgcgtttgaaactacaagactagaatatgtcagaggggggtagaattccacgtgtagcagtgaaatgcgtagagatgtggaggaataccaatggcgaaggcagccccctgggataatattgacgctcatgcacgaaagcgtggggagcaaccaggattagatacctggtagtccacgccctaaacgatgtttactagttgttggtggagtaaaatccatgagtaacgcagctaacgcgtgaagtagaccgcctggggagtacggtcgcaagattaaaactcaaaggaattgacgggggcccgcacaagcggtggattatgtggattaattcgatgcaacgcgaaaaaccttacctggccttgacatgccactaacgaagcagagatgcattaggtgctcgaaagagaaagtggacacaggngctgcatggctgtcgtcagctcgtgtcgtgagatgttgggttaagtcccgcaacgagcgcaacccttgccaataattgccatcatttagttgggcactttattgggactgccggtgacaaaccggaggaaggtggggatgacgtcaagtcctcatggcccttatggccagggcttcacacgtaatacaatggtcggtacagagagttgccaacccgcgagggggagccaatctcagaaagccgatcgtagtccggattgcaggctgcaactcgcctgcatgaagtcggaatcgctagtaatcgcggatcagcatgtcgcggtgaatacgttcccgggcc

SEQ ID NO: 1230 - DNA, 1472 bp, Microbacterium chocolatum
  modified_base (176)..(179): a, c, t, g, unknown or other
tgcttacaacatgcaagtcgaacggtgaagccaagattgcttggtggatcagtggcgaacgggtgagtaacacgtgagcakcctgccctgaactctgggataagcgctggaaacggcgtctaatactggatatgagctgcggaggcatcttcgtggttggaaagatttttcggttnnnnatgggctcgcggcctatcagcttgttggtgaggtaatggctcaccaaggcgtcgacgggtagccggcctgagagggtgaccggccacactgggactgagacacggcccagactctacgggaggcagcagtggggaatattgcacaatgggcggaagcttgatgcagcaacgccgcgtgagggatgacggcttcgggttgtaaacctcttttagcagggaagaagcgaaagtgacggtacctgcagaaaaagcgccggctaactacgtgccagcagccgcggtaatacgtagggcgcaaccgttatccggaattattgggcgtaaagagctcgtaggcggtttgtcgcgtctgctgtgaaatcccgaggctcaacctcgggtgtgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaagaggcttagataccctggtagtccaccccgtaaacgttgggaactagttgtggggtccattcctcggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgctgcagaaatgtagaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggtagacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcgctggatcacctcc

SEQ ID NO: 1231 - DNA, 1475 bp, Microbacterium flavescens
gatgaacgctggcggcgtgcttaacacatgcaagtcgaacggtgaagcagagcttgctctgtggatcagtggcgaacgggtgagtaacacgtgagcaacctgccccggactctgggataagcgctggaaacggcgtctaatactggatatgaatcgcgaccgcatggtcagtggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggacgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgctgcagaaatgtagaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1232 - DNA, 1317 bp, Microbacterium gubbeenense
  modified_base (71)..(71): a, c, t, g, unknown or other
  modified_base (98)..(98): a, c, t, g, unknown or other
  modified_base (132)..(132): a, c, t, g, unknown or other
  modified_base (188)..(188): a, c, t, g, unknown or other
  modified_base (197)..(197): a, c, t, g, unknown or other
acagttggaaacagctgctaataccggatacgcacgagaaccgcatggttactcgtgggaaagatttttcngttcgggaggggctcgcgtcctatcancttgttggtgaggtagtggctcaccaaggcgtcnacgggtagccggcctgagagggtgaccggccacactgggactgagacacggcccanactcctacnggaggcagcagtggggaatattgcacaatgggcgcaagcctgatgcagcaacgccgcgtgagggacgacggccttcgggttgtaaacctcttttagttgggaagaagccttcgggtgacggtaccttcagaaaaagcaccggctaactacgtgccagcagccgcggtaatacgtagggtgcaagcgttatccggaattattgggcgtaaagagctcgtaggcggtttgtcacgtctgctgtgaaaactggaggctcaacttccagcttgcagtgggtacgggcagacttgagtgcggtaggggagattggaattcctggtgtagcggtggaatgcgcagatatcaggaggaacaccgatggcgaaggcagatctctgggcccgtaactgacgctgaggagcgaaagagtggggagcaaacaggcttagataccctggtagtccactccgtaaacgttgggaactagttgtgggggcctttctacggtctccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatataccggaaacggcttggaaacagtcgcccccttgtggtcggtatacaggtggtgcatggttgtcgtcagctcgtgtcgtgagatgttgggttaaagtcccgcaacgagcgcaaccctcgttctatgttgccagcacgttatggtgggaactcatggaatactgccggggtcaactcggaggaaggtggggatgacgtcaaatcatcatgccccttatgtcttgggcttcacgcatgctacaatggccggtacaatgggctgcgataccgtgaggtggagcgaatcccaaaaagccggtcccagttcggattgtagtctgcaactcgactacatgaagtcggagtcgctagtaatcgcagatcagcaacgctgcggtgaatacgttcccgggtcttgtacacaccgcccgtcaagtcatgaaagtcggtaacacctgaagccggtggcctaaccccttgtgggagggagctgtcgaaggtggga

SEQ ID NO: 1233 - DNA, 1479 bp, Microbacterium lacticum
tttgcaaagcgtttgtggcgtgcttaacacatgcatatcgaacggtgaaggcggagcttgctctgctggatcagtggcgaacgggtgagtaacacgtgagcaatctgcccctgactctgggataagcgctggaaacggcgtctaatactggatacgagctgcgaaggcatcttcagcagctggaaagaayttcggtcagggatgagctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaccccgaggctcaacctcgggcctgcagtgggtacgggcagactagagtgcggtagrggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtcatggtgggaactcatggaatactgccggggtcaactcggaggaaggtgaggatgacgtcaaatcatcatgccccttatgtcttgggcttcacgcatgctacaatggccggtacaatgggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1234 - DNA, 1475 bp, Microbacterium oleivorans
gatgaacgctggcggcgtgcttaacacatgcaagtcgaacggtgaagcagagcttgctctgtggatcagtggcgaacgggtgagtaacacgtgagcaacctgcccctgactctgggataagcgctggaaacggcgtctaatactggatatgagctgcgaccgcatggtcagcagttggaaagatttttcggtctgggatgggctcacggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggattggtaattaggactaagtcgtaacaaggtagccgtaccggaagg

SEQ ID NO: 1235 - DNA, 1467 bp, Microbacterium oxydans
tggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaagg

SEQ ID NO: 1236 - DNA, 1490 bp, Microbacterium paraoxydans
tagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggaggggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagctgtcgaaggtgggatcggtaattaggactaagtcgtaacaaggtagccgta

SEQ ID NO: 1237 - DNA, 1474 bp, Microbacterium phyllosphaerae
gctgaacgctggcggcgtgcttaacacatgcaagtcgaacggtgaagcccagcttgctgggtggatcagtggcgaacgggtgagtaacacgtgagcaatctgcccctgactctgggataagcgctggaaacggcgtctaatactggatacgaacagcgaccgcatggtcagttgttggaaagaatttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaagg

SEQ ID NO: 1238 - DNA, 1460 bp, Microbacterium schleiferi
tggcggcgtgcttaacacatgcaagtcgaacggtgaagcagagcttgctctgtggatcagtggcgaacgggtgagtaacacgtgagcaatctgcccctgactctgggataagcgctggaaacggcgtctaataccggatacgagctgcgaaggcatcttcagcagctggaaagaatttcggtcagggatgagctcgcggcctatcagcttgttggtgaggtaacggctcaccaagccgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcaggaaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccg

SEQ ID NO: 1239 - DNA, 1475 bp, Microbacterium sp. 768
gatgaacgctggcggcgtgcttaacacatgcaagtcgaacggtgaagcccagcttgctgggtggatcagtggcgaacgggtgagtaacacgtgagcaacctgcccctgactctgggataagcgctggaaacggcgtctaatactggatacgaaccacagtcgcatggctcgtggttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacaccctagaaataggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1240 - DNA, 1474 bp, Microbacterium sp. oral strain C24KA
aggatgaacgctggcggcgtgcttaacacatgcaagtcgaacggtgaaggcccagcttgctgggtggatcagtggcgaacgggtgagtaacacgtgagcaatctgcccctgactctgggataagcgctggaaacggcgtctaatactggatatgaaccgtggaggcatcttcaacggttggaaagattttttggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccgg

SEQ ID NO: 1241 - DNA, 1474 bp, Microbacterium testaceum
gatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaagg

SEQ ID NO: 1242 - DNA, 1497 bp, Micrococcus antarcticus
tcagaacgaacgctggcggcgtgcttaacacatgcaagtcgaacgatgaagcccagcttgctgggtggattagtggcgaacgggtgagtaacacgtgagtaacctgcccttgactctaggataagcccgggaaactgggtctaatactggataggaacgtctaccgcatggtgggtgttggaaagaatttcggtcatggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaacattccacgttttccgcgccgcagctaacgtattaggtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacttcgggtggggactcatgggagactgccggggtcgactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggagggggccgtcgaaggtgggaccagcgattgggactaagtcgtaacaaggtagccgtaccggaaggtgcggctggatcacctcctt

SEQ ID NO: 1243 - DNA, 1632 bp, Micrococcus luteus
ttacggagagtttgatcctggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttcccgatcgccgtagagatacgatttcccctttggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtgggagggagccgtcgaaggtgggaccagcgattgggactaagtcgtaacaaggtagccgtaccggaaggtgcggctggatcacctcctttctaaggagcatcagtgcccgttgcatcaccgcgtgtgtgatggcgggttgctcatgggtggaacatcaatgaatggtgccagtggtggtgccggcagtgctcgagtacg

SEQ ID NO: 1244 - DNA, 1472 bp, Micrococcus lylae
gatcctggctcaggatgaacgctggcggcgtgcttaacacatgcaagtcgaacgatgaagctccagcttgctggggtggattagtggcgaacgggtgagtaacacgtgagtaacctgcccttgactctgggataagccttggaaacggggtctaataccggataggagcattcaccgcatggtgggtgttggaaagaatttcggtcttggatggactcgcggcccatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgccgtgaaagtccggggcttaactccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgtttggcactaggtgtgggggccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgttcgccgtagagatacggtttcccctttggggcgggttcacaggtggtgcatggttgtcgtcagctcgtgtcgtgagatgttgggttaagtcccgcaacgagcgcaacccctgttctatgttgccagcacgtgatggtggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagttggagtcgctagtaatcgcagatcagcaacgctgcggtgaatacgttcccgggccttgtacacaccgcccgtcaagtcacgaaagtcggtaacacccgaagccggtggcctaacccttgtggaaggagccgtcgaaggtgggactggcgattgggactaagtcgtaacaag

SEQ ID NO: 1245 - DNA, 1469 bp, Micrococcus sp. 185
  modified_base (977)..(977): a, c, t, g, unknown or other
cgctggcggcgtgcttaacacatgcaagtcgaacgatgaagcccagcttgctgggtggattagtggcgaacgggtgagtaacacgtgagtaacctgcccttaactctgggataagcctgggaaactaggtctaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttccccttnggggcgggttcacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccagcgattgggactaagtcgtaacaaggtagccgtaccggaagg

SEQ ID NO: 1246 - DNA, 1502 bp, Microcystis aeruginosa
ttcatcatggagagtttgatcctggctcaggatgaacgctggcggcgtgcctaacacatgcaagtcgaacgggaatcttcggattctagtggcggacgggtgagtaacgcgtaagaatctaacttcaggacggggacaacagttggaaacgactgctaatacccgatatgccgcgaggtgaaacctaattggcctgaagaagagcttgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggtctttggattgtaaacctcttttctcaaggaagaagttctgacggtacttgaggaatcagcctcggctaactccgtgccagcagccgcggtaatacgggggaggcaagcgttatccggaattattgggcgtaaagcgtccgcaggtggtcagccaagtctgctgtcaaatcaggttgcttaacgacctaaaggcggtggaaactggcagactagagagcagtaggggtagcaggaattcccagtgtagcggtgaaatgcgtagagattgggaagaacatcggtggcgaaagcgtgctactgggctgtatctgacactcagggacgaaagctaggggagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaaccctggtgaaagctgggggtgccttcgggagcgcgaacacaggtggtgcatggctgtcgtcagctcgtgtcgtgagatgttgggttaagtcccgcaacgagcgcaaccctcgttcttagttgccagcattaagttggggactctaaggagactgccggtgacaaaccggaggaaggtggggatgacgtcaagtcagcatgccccttacgtcttgggcgacacacgtactacaatggtcgggacaaagggcagcgaactcgcgagagccagcgaatcccagcaaacccggcctcagttcagattgcaggctgcaactcgcctgcatgaaggaggaatcgctagtaatcgccggtcagcatacggcggtgaattcgttcccgggccttgtacacaccgcccgtcacaccatggaagctggtcacgcccgaagtcattacctcaaccgcaaggagggggatgcctaaggcagggctagtgactggggtgaagtcgtaacaaggtagccgtaccggaaggtgtggctggatcacctccttaaagggagacc

SEQ ID NO: 1247 - DNA, 1543 bp, Mitsuokella jalaludinii
tgatcctggctcaggacgaacgctggcggcgtgcttaacacatgcaagtcgtacgagacgattgaaagcttgcttttgaaagtcgagtggcaaacgggtgagtaacgcgtagacaacctgccgtaaagatggggacaacagttcgaaaggactgctaataccgaatgttgtagagtttccgcatgggaatcctactaaaggtggcctctacttgtaagctatcgctttacgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttccaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagggctagagatagttccctctcttcggagacacgaaaacaggtggtgcatggctgtcgtcagctcgtgtcgtgagatgttgggttaagtcccgcaacgagcgcaacccctatcctttgttgccagcacgcaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcactc

SEQ ID NO: 1248 - DNA, 1559 bp, Mitsuokella multacida
tggagagtttgatcctggctcaggacgaacgctggcggcgtgcttaacacatgcaagtcgaacgagacgattgaaagcttgcttttgaaagtcgagtggcaaacgggtgagtaacgcgtagacaacctgccgtaaagatggggacaacagtccgaaaggactgctaataccgaatgttgtggaacttccgcatgggagctctactaaagatggcctctacttgtaagctatcgctttacgatgggtctgcgtctgattagctagttggtggggtaatggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttccaatgacggtacctgacgaggaagccacggctaactacgtgccagcagccgcggtaatacgtaggtggcgagcgttgtccggaattattgggcgtaaagggagcgcaggcgggagatcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagagctagagatagctccctctcttcggagacacgaaaacaggtggtgcatggctgtcgtcagctcgtgtcgtgagatgttgggttaagtcccgcaacgagcgcaacccctatcctttgttgccagcacgtaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaaggtgcggctggatcacctcctttct

SEQ ID NO: 1249 - DNA, 1224 bp, Mitsuokella sp. oral taxon 521
gacgaacgctggcggcgtgcttaacacatgcaagtcgaacgagacaattaaaagcttgcttttaaacgtcgagtggcaaacgggtgagtaacgcgtagacaacctgccgcaaagatggggacaacagttcgaaaggactgctaataccgaatgttctggaagttccgcatggaaactccagcaaagatggcctctacttgtaagcgatcgctttgcgatgggtctgcgtctgattagctagttggcagggcaacggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgccggggacgacatgtaggcagtgcgaacagcattgtgtaatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaagcggaattcctagtgtagcggtgaaatgcgtagatattaggaagaacaccagtggcgaaggcggctttctggactgtaactgacgctgaggctcgaaagccaggggagcgaacgggattagataccccggtagtcctggccgtaaacgatgaatgctaggtgtagggggtatcgacccctcctgtgccggagttaacgcaataagcattccgcctggggagtacggtcgcaagactgaaactcaaaggaattgacgggggcccgcacaagcggtggagtatgtggtttaattcgacgccacgcgatgaaccttaccagggcttgacattgagtgacagacttagagacaagtcattctcttcggagacacgaaaactggtggtgcatggctgtcgtcagctcgtgtcgtgagatgtagggttagttccgcacgagcgcaccccctattctctgttgccagcacgcgaaggtgggaactcaaaggaaactgccgccgaaccagccggagaaaggcggggaatacgtcagttatcatgccccctagttcgtggctacaccgttca

SEQ ID NO: 1250 - DNA, 1210 bp, Mitsuokella sp. oral taxon G68
gacgaacgctggcggcgtgcttcaacacatgcaagtcgaacgagacaattaaaagcttgcttttcaaacgtccgagtggcaaacgggtgagtcaacgcgtagacaacctgccgcaaagatggggacaacagttccgaaaggactgctaataccgaatgttcctggaagttcccgcatggaaactcccagcaaagatggcctcctacttgtaagcgatccgctttgcgatgggtcctgcgtcctgattagctagttggtgaggtaacggcctaccaaggcgacgatcagtagccggtcctgagaggatgaacggccacattgggactgagacacggcccagactccctacgggaggcagcagtggggaatccttccgcaatgggcgaaagcctgacggagcaacgccgcgtgagtgaagaaggtccttcggatccgtaaagctctgttgccggggacgagtgtaggcaatgcaaacagcattgtgtaatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaggcggaattcctagtgtagcggtgaaatgcgtagatattaggaagaacaccagtggcgaaggcggctttctggactgtaactgacgctgaggctcgaaagccaggggagcgaacgggattagataccccggtagtcctggccgtaaacgatgaatgctaggtgtagggggtatcgacccctcctgtgccggagttaacgcaataagcattccgcctggggagtacggtagcaagactgaaactcaaaggaattgacgggggcccgcacaagcggtggagtatgtggtttaattcgacgcaacgcgaagaacttaccaggtcttgacatagagtgacagacttagagacaagtcattctcttcggagacacgagaacagggtggtgcatggctgtcgtcagctcgtgtcgtgagatgtttgggttagttccgccacgagcgcacgcctattctctgttgccagcactgcgatggtgggaactcgaggagacgcgccgacacgccgaggaggcgggatagttagtagcatccctag

SEQ ID NO: 1251 - DNA, 1544 bp, Mobiluncus curtisii
tttttttggagagtttgatcctggctcaggacgaacgctggcggcgtgcttaacacatgcaagtcgaacgatgaagccgcagcttgctgtggtggattagtggcgaacgggcgagtaacacgtgagtaacctgtccttttctttgggataacggctggaaacggctgctaatactggatattcaggcgtcaccgcatggtggtgtttggaaaggttttttctgggattgggtgggctcgcggcctatcagcttgttggtggggtgatggcttaccaaggctttgacgggtagccggcctgagagggtggtcggtcgcactgggactgagatacggcccagactcctacgggaggcagcagtggggaatattgcacaatggacgaaagtttgatgcagcgacgccgcgtggagggtgtaggccttcgggttgtgaactcctttttctcgcgaaaaaggcacagttttggctgtgttgatggtagtgggggaagaagcgccggctaactacgtgccagcagccgcggtaatacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacactgaggagcgaaagcgtggggagcgaacaggattagataccctggtagtccacgctgtaaacgttgggaactaggtgtggggatgctatcctgtgtttctgcgccgtagctaacgcattaagttccccgcctggggagtacggtcgcaaggctaaaactcaaaggaattgacgggggcccgcacaagcggcggagcatgcggattaattcgatgcaacgcgaagaaccttaccaaggcttgacatacactgcgatggttccagagatgggccagccttcggggtggtgtacaggtggtgcatggttgtcgtcagctcgtgtcgtgagatgttgggttaagtcccgcaacgagcgcaacccttgcctcatgttgccagcggttcggccggggactcgtgagggactgccggggttaactcggaggagggtggggatgacgtcaaatcatcatgccccttatgtcttgggcttcacgcatgctacaatggccagtacagagggttgcgataccgtgaggtggggctaatctcttaaagctggtctcggttcggattggggtctgcaactcgaccccatgaagttggagtcgctagtaatcgcagatcagcattgctgcggtgaatacgttctcgggccttgtacacaccgcccgtcacgtcacgaaagttggtaacacccgaagcccgtggcttaactctttttgagggggagcggtcgaaggtgggattggcgattgggacgaagtcgtaacaaggtagccgtaccggaaggtgcggctggatcacctcctttct

SEQ ID NO: 1252 - DNA, 1542 bp, Mobiluncus mulieris
ttttgttggagagtttgatcctggctcaggacgaacgctggcggcgtgcttaacacatgcaagtcgaacgatgaagccgcagcttgctgtggtggattagtggcgaacgggcgagtaacacgtgagtaacctgtccttttctttgggataacggctggaaacggctgctaatactggatattcaggctgcatcgcatggtgtggtttggaaaggttttttctggaatggggtgggctcgcggcctatcagcttgttggtggggtgatggcttaccaaggctttgacgggtagccggcctgagagggtggtcggtcgcactgggactgagatacggcccagactcctacgggaggcagcagtggggaatattgcacaatggacggaagtttgatgcagcgacgccgcgtggagggtgtaggccttcgggttgtgaactcctttttctcgtgaaaaaggcatgcttttgggtgtgttgatggtagcgggggaagaagcgccggctaactacgtgccagcagccgcggtaatacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacgctgaggagcgaaagcgtggggagcgaacaggattagataccctggtagtccacgctgtaaacgttgggaactaggtgtggggatgctatcctgtgtttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacactgcgacatgccagagatggtgtggccttcggggtggtgtacaggtggtgcatggttgtcgtcagctcgtgtcgtgagatgttgggttaagtcccgcaacgagcgcaacccttgcctcatgttgccagcacgttatggtggggactcgtgagggactgccggggttaactcggaggagggtggggatgacgtcaaatcatcatgccccttatgtcttgggcttcacgcatgctacaatggccagtacagagggttgcgataccgtgaggtggggctaatctcttaaagctggtctcggttcggattggggtctgcaactcgaccccatgaagttggagtcgctagtaatcgcagatcagcattgctgcggtgaatacgttctcgggccttgtacacaccgcccgtcacgtcacgaaagttggtaacacccgaagcccgtggcctagcctttttggggggagcggtcgaaggtgggattggcgattgggacgaagtcgtaacaaggtagccgtaccggaaggtgcggctggatcacctcctttct

SEQ ID NO: 1253 - DNA, 1532 bp, Moellerella wisconsensis
agagtttgatcatggctcagattgaacgctggcggcaggcctaacacatgcaagtcgagcggtaacaggaagaagcttgcttctttgctgacgagcggcggacgggtgagtaatgtatggggatctgcctgacagagggggataactactggaaacggtagctaataccgcataatctctaaggagcaaagcaggggaccttcgggccttgcgctgtcggatgaacccatatgggattagctagtaggtggggtaacggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagtcgggaggaaggcgttgatattaatactatcagcgattgacgttaccgacagaagaagcaccggctaactccgtgccagcagccgcggtaatacggggggtgcaagcgttaatcggaattactgggcgtaaagcgcacgcaggcggttgattaagttagatgtgaaatccccgggcttaacctgggaatggcatctaaaactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaagggagactgccggtgataaaccggaggaaggtggggatgacgtcaagtcatcatggcccttacgagtagggctacacacgtgctacaatggcgcatacaaagagaagcgaactcgcgagagccagcggaactcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctt

SEQ ID NO: 1254 - DNA, 1455 bp, Mogibacterium diversum
  modified_base (792)..(793): a, c, t, g, unknown or other
acgctggcggcgtgcctaatacatgcaagtcgagcgagatgttagcgcatgaaccttcgggggattatgctaacggacagcggcggacggtgtgagtaacgcgtaggcaacctgcccctgacagagggatagccattggaaacgatgattaaaaccatcatgacaccgtagaagcacatgcttcatcggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctactttagtgcaggaggggaaagcggaattcctagtgtagcggtgaaatgcgtagatattaggaggaacaccagcggctgaaggtcggtctttctggactgtaactgacactgaggcacgaaagcgtgggtagcaaacaggattagataccctggtagtccacgccgtaaacgatgagcactanntgttgggcccgttagggctcagtgccgcagttaacgcaataagtgctccgcctggggagtacgctcgcaagagtaaaactcaaaggaattgacggggacccgcacaagcagcggagcatgtggtttaattcgaagcaacgcgaagaaccttaccagggcttgacatcctgctgacaggaccttaaccggtcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagaggcaatactgtgaagtggagcaaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatggaagttgggggtgcccaaagtcgtttaattaatctatcgcctaaggcaaaaccaatgactggggtgaagtcgtaacaaggta

SEQ ID NO: 1255 - DNA, 1478 bp, Mogibacterium neglectum
agtttgatcatggctcaggatgaacgctggcggcgtgcctaatacatgcaagtcgagcgagatgttagcgcatgaaccttcgggggattatgctaacggaaagcggcggacgggtgagtaacgcgtaggcaacctgcccctgacagagggatagccattggaaacgatgattaaaacctcatgacaccgatgaagcacatgcttcatcggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagcgtgggtagcaaacaggattagataccctggtagtccacgccgtaaacgatgagcactaggtgttgggcccgttaggctcagtgccgcagttaacgcaataagtgctccgcctggggagtacgctcgcaagagtaaaactcaaaggaattgacggggacccgcacaagcagcggagcatgtggtttaattcgaagcaacgcgaagaaccttaccagggcttgacatcctgctgacaggaccttaaccggtcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgggatgcaatactgtgaagtggagcaaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatgggaagttgggggtgcccaaagtcggttaattaatctatcgcctaaggcaaaaccaatgactggggtgaagtcgtaacaaggtaaccgt

SEQ ID NO: 1256 - DNA, 1466 bp, Mogibacterium pumilum
  modified_base (946)..(947): a, c, t, g, unknown or other
ttgatcctggctcaggatgaacgctggcggcgtgcctaatacatgcaagtcgagcgagatgttagtgcatgaacttcgggggattatattaacggacagcggcggacgggtgagtaacgcgtaggcaacctgcccttgacagagggatagccattggaaacgatgattaaaacctcataacaccgtagaagcacatgcttcaacggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatggcgaaagcctgatgcagcaacgccgcgtgaaggatgaaggcttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagcgtgggtagcaaacaggattagataccctggtagtccacgccgtaaacgatgagcactaggtgttgggtccgttaggctcagtgccgcagttaacgcaataagtgctccgcctggggagtacgctcgcaagagtaaaactcaaaggaattgacggggacccgcacaagcagcggacatgtggtttaattcgaagcaacgcgnnagaaccttaccagggcttgacatcctgctgacaggatcttaaccgatcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagaggcaatactgcgaagtggagcgaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatggaagttgggggtgcccgaagtcggctaattaatctgtcgcctaaggcaaaaccaatgactggggtgaagtcgtaacaaggta

SEQ ID NO: 1257 - DNA, 1480 bp, Mogibacterium timidum
agagtttgatcctggctcaggatgaacgctggcggcgtgcctaatacatgcaagtcgagcgagaagcttggaaatgacgcttcggttgaatttccaagcggacagcggcggacgggtgagtaacgcgtaggcaacctgcccctgtacagagggatagccattggaaacgatgattaaaacctcatgacaccgtagtagcacatgctacatcggtcaaagatttatcggtcagggatgggcctccgtctgattaactggttggtgaggtaacggctcaccaaggtgacgatcagtagccgacctgagagggtgatcggccacattggaactgagacacggtccaaacttctacggaaggcagcagtagggaatcttgcacaatgggcgtaagcctgatgcagcaacgccgcgtgaaggatgaaggcttcgggttgtaaacttctgttctaagggaagaaagaaatgacggtaccttaggagcaagccccggctaactacgtgccagcagccgcggtaatacgtagggggcaagcgttatccggaattattgggcgtaaagagtgcgtaggtggttacctaagcgcaaggtttaaattagaggctcaacctctacatgccttgcgaactgggctacttgagtgcaggaggggaaagcggaattcctagtgtagcggtgaaatgcgtagatattaggaggaacaccggcggcgaaggcggctttctggactgtaactgacactgaggcacgaaagcgtgggtagcaaacaggattagataccctggtagtccacgccgtaaacgatgagcactaggtgttgggtccgttaggactcagtgccgcagttaacgcaataagtgtccgcctgggagtacgctcgcaagagtaaactcaaggaattgacgggcacccgcacaagcaggggagcttgtggtttaattcgaagcaacgcgaagaaccttaccagggcttgacatcctgctgacagaaccttaatcggttttttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagatgcaatactgcgaagtggagcgaaacaccaaaaccgatcccagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccaaagtcggttaattaatctatcgcctaaggcaaaaccaatgactggggtgaagtcgtaacaaggtacccgtagga

SEQ ID NO: 1258 - DNA, 1400 bp, Mollicutes bacterium pACH93
gcaagtcgaacgaagaactagcttgctagttcttagtggcgaacgggtgagtaatacataaataatctgtccatatgactgggataactattggaaacgatagctaataccggataggttaattgaaggcatcttcgattaattaaagtaggttttctacacaaatggatgagtttatggcgcattagttagttggtggggtaacggcctaccaagacgatgatgcgtagccgacctgagagggtgaccggccacactgggactgagacacggcccagactcctacgggaggcagcagtagggaattttcggcaatgggcgcaagcctgaccgagcaacgccgcgtgagtgattaaggccttcgggttgtaaagctctgttgtaagggaagaaaaatcagtagaggaaatgatactgatcagacggtaccttaccagaaagccacggctaactacgtgccagcagccgcggtaatacgtaggtggcaagcgttatccggaattattgggcgtaaagggtgcgtaggcggtttattaagtctatggtgaaagtgcggggctcaaccccgtatggccatagaaactgatagactagagtgcaggagagggcaatggaattccatgtgtagcggtaaaatgcgtagatatatggaggaacaccagtggcgaaggcggttgcctggcctgtaactgacgctgaagcacgaaagcgtggggagcaaataggattagataccctagtagtccacgccgtaaacgatgaatactaagtgttggagaaattcagtgctgcagttaacgcaataagtattccgcctggggagtatgcacgcaagtgtgaaactcaaaggaattgacgggaccccgcacaagcggtggattatgttgtttaattcgacgcaacgcgaagaaccttaccaggccttgacatactcagcaaaaccctagagatagggtggaggttatctgggatacaggtggtgcatggttgtcgtcagctcgtgtcgtgagacgttgggttaagtcccgcaacgagcgcaacccttgtctttagttaccatcattcagttggggactctagagagactgccggtgataaaccggaggaaggtggggatgacgtcaaatcatcatgccccttatggcctgggctacaaacgtaatacaatggcgtatacaaagggatgcgaaagggtgacctggagcaaaactcacaaagtacgtctcagttcagattggagtctgcaactcgactccatgaaggcggaatcgctagtaatcgcggatcagcatgccgcggtgaatacgttctcggggtttgtacacaccgcccgtcaaaccatgagagttggtaatacccgaagccggtggcctaacctagtaataggagggagccgtcga

SEQ ID NO: 1259 - DNA, 1555 bp, Moorella thermoacetica
gtttgatcctggctcaggacaaacgctggcggcgtgcctaacacatgcaagtcgagcggtctttaattggggaaatcttcggatggaaccgattaaagatagcggcggacgggtgagtaacgcgtgggtaatctacccttcagactgggataacaccgggaaactggtgctaataccggatacggtctacgggaggcatcttctgtagaagaaaggtggcgcaagctaccgctgaaggatgagcccgcgtcccattagctagttggtgaggtaacggctcaccaaggcgacgatgggtagccggcctgagagggtggtcggccacactgggactgagacacggcccagactcctacgggaggcagcagtggggaatcttgcgcaatgggcgaaagcctgacgcagcaacgccgcgtgagcgatgaaggccttcgggttgtaaagctctgtcatcagggacgaagtcttaaaggcgaatagcctttaaggtgacggtacctgaggaggaagccccggctaactacgtgccagcagccgcggtaaaacgtagggggcgagcgttgtccggaattactgggcgtaaagggcgtgtaggcggcctggcaagtcagatgtgaaaaaccccggcttaaccgggggcatgcatttgaaactgccgggcttgagggcaggagaggagagtggaattcccggtgtagcggtgaaatgcgtagatatcgggaggaacaccagtggcgaaggcgactctctggcctggccctgacgctgaggcgcgaaagcgtggggagcaaacaggattagataccctggtagtccacgccgtaaacgatgggtactaggtgtaggaggtatcgaccccttctgtgccgcagtaaacacaataagtaccccgcctggggagtacggccgcaaggctgaaactcaaaggaattgacgggggcccgcacaagcggtggagcatgtggtttaattcgacgcaacgcgaagaaccttaccggggtttgacatcctgcgaacctggtggaaacactggggtgcccttcggggaacgcagagacaggtggtgcatggttgtcgtcagctcgtgtcgtgagatgttgggttaagtcccgcaacgagcgcaacccctacctttagttgccagcgggtaaagccgggcactctaaagggactgccggtgacaaaccggaggaaggtggggatgacgtcaaatcatcatgccccttatatcccgggctacacacgtgctacaatggcctgtacaaaggggtgcgaaggagcgatccggagcgaatcccaaaaagcaggtctcagttcggattgcaggctgcaactcgcctgcatgaagtcggaatcgctagtaatcgcggatcagcatgccgcggtgaatacgttcccgggccttgtacacaccgcccgtcacaccacgaaagctggcaacacccgaagccggtgacctaacccgcgagggaaggagccgtctaaggtggggctggtgattggggtgaagtcgtaacaaggtagccgtatcggaaggtgcggctggatcacctcc

SEQ ID NO: 1260 - DNA, 1532 bp, Moraxella catarrhalis
ttaaactgaagagtttgatcatggctcagattgaacgctggcggcaggcttaacacatgcaagtcgaacgaagttaggaagcttgcttctgatacttagtggcggacgggtgagtaatgcttaggaatctgcctagtagtgggggataacttggggaaacccaagctaataccgcatacgacctacgggtgaaagggggcttttagctctcgctattagatgagcctaagtcggattagctggttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagcttatggttaatacccataagccctgacgttacccacagaataagcaccggctaactctgtgccagcagccgcggtaatacagagggtgcaagcgttaatcggaattactgggcgtaaagcgcgcgtaggtggttatttaagtcagatgtgaaagccccgggcttaacctgggaactgcatctgatactggataactagagtaggtgagaggggagtagaattccaggtgtagcggtgaaatgcgtagagatctggaggaataccgatggcgaaggcagctccctggcatcatactgacactgaggtgcgaaagcgtgggtagcaaacaggattagataccctggtagtccacgccgtaaacgatgtctaccagtcgttgggtcttttaaagacttagtgacgcagttaacgcaataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcttgcagagatgcgagagtgccttcgggaattcacatacaggtgctgcatggctgtcgtcagctcgtgtcgtgagatgttgggttaagtcccgcaacgagcgcaacccttttccttagttaccagcgactcggtcgggaactctaaggatactgccagtgacaaactggaggaaggcggggacgacgtcaagtcatcatggcccttacgaccagggctacacacgtgctacaatggttggtacaaagggttgctacacagcgatgtgatgctaatctcaaaaagccaatcgtagtccggattggagtctgcaactcgactccatgaagtcggaatcgctagtaatcgcagatcagaatgctgcggtgaatacgttcccgggccttgtacacaccgcccgtcacaccatgggagttgatctcaccagaagtggttagcctaacgcaagagggcgatcaccacggtggggtcgatgactggggtgaagtcgtaacaaggtagccgtaggggaacctgcggctggatcacctcctta

SEQ ID NO: 1261 - DNA, 1501 bp, Moraxella lincolnii
attgaacgctggcggcaggcttaacacatgcaagtcgaacgaagaggtctagcttgctagactgattagtggcgaacgggtgagtaacatttaggaatctaccttatagagggggatagctcggggaaactcgaattaataccgcatacgacctacgggtgaaagggggcgcaagctcttgctataagatgagcctaaaccagattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagccatgccgcgtgtgtgaagaaggccttatggttgtaaagcacttttaagtggggagaaaagcttatggataacacccataggttctgacgttacccacagaataagcaccggctaactctgtgccagcagccgcggtaatacagagggtgcaagcgttaatcggaattactgggcgtaaagcgagcgtaggtggtttattaagtcagatgtgaaatccctgggcttaacctaggaactgcatctgatactgataaactagagtaggtgagaggaaagtagaattccaggtgtagcggtgaaatgcgtagagatctggaggaataccgatggcgaaggcagctttctggcatcatactgacactgaggttcgaaagcgtgggtagcaaacaggattagataccctggtagtccacgccgtaaacgatgtctaccagtcgttgggtcttttaaaggcttagtgacgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcttgcagagatgcgagagtgcctttgggaattcacatacaggtgctgcatggctgtcgtcagctcgtgtcgtgagatgttgggttaagtcccgcaacgagcgcaacccttttccttagttaccagcgacttggtcggggactttaaggacactgccagtgacaaactggaggaaggcggggacgacgtcaagtcatcatggcccttacgaccagggctacacacgtgctacaatggtaggtacagagggcagctacacggcgacgtgatgccaatctcaaaaagcctatcttagtccagattggagtctgcaactcgactccatgaagtcggaatcgctagtaatcgcggatcagaatgccgcggtgaatacgttcccgggccttgtacacaccgcccgtcacaccatgggagttgattgcaccagaagtggttagcctaacttaggagggcgatcaccacggtgtggttaatgactggggtgaagtcgtaacaaggtagccgtaggggaacctgcggctggatcacctcctta

SEQ ID NO: 1262 - DNA, 1522 bp, Moraxella osloensis
tagagtttgatcatggctcagattgaacgctggcggcaggcttaacacatgcaagtcgaacgatgactctctagcttgctagagatgattagtggcggacgggtgagtaacatttaggaatctacctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgccttcgggaactcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcggatcagaatgccgcggtgaatacgttcccgggccttgtacacaccgcccgtcacaccatgggagtctattgcaccagaagtaggtagcctaacgaaagagggcgcttaccacggtgtggtcgatgactggggtgaagtcgtaacaaggtagccgtaggggaacctgcggttggatcacctc

SEQ ID NO: 1263 - DNA, 1450 bp, Moraxella sp. 16285
attgaacgctggcggcaggcttaacacatgcaagtcgaacgatrgaacctagcttgctaggggaaatagtggcgaacgggtgagtaacatttaggaaactgccttatagagggggatagctcggggaaactcgaattaataccgcatacgtcctacgggagaaaggagctttagggttctgctataagatgtgcctaaattagattagctagatggtgaggtaaaggctcaccatggcgacgatctataactggtcttagaggatgatcagtcacaccggaactgagacacggtccggactcctacgggaggcagcagtggggaatattggacaatgggggcaaccctgatccagccatgccgcgtgtgtgaagaaggtcataagattgtaaagcactttaagcagggaggaagagccagtggagaaacacactggtggtgacgttacctgcagaataagcaccggctaactctgtgccagcagccgcggtaatacagagggtgcgagcgttaatcggaattactgggcgtaaagcgggtgcaggtggtgcactaagtcatatgtgaaagccctgggcttaacctaggaacagcatatgatactggtgaactagagtatatgagaggraagtagaattccaggtgtagcggtgaaatgcgtagagatctggaggaataccgatggcgaaggcagctttctggcacaatactgacactcagacccgaaagcgtgggtagcaaacaggattagataccctggtagtccacgccgtaaacgatgtctactagccgttggrgctcatgaagcyttagtggcgcagctaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagratcctacagagatgtgggagtgccythgggaaytcacatacaggtgctgcatggctgtcgtcagctcgtgtcgtgagatgttgggttaagtcccgcaacgagcgcaacccttatccttacttgctagcrggtaragcygagaactgtaaggagactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccggattggagtctgcaactcgactycatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtg

SEQ ID NO: 1264 - DNA, 1226 bp, Moraxella sp. GM2
ctggctcagattgaacgctggcggcaggcttaacacatgcaagtcgaacgagtggcggacgggtgagtaacatttaggaatctgcctagtagtgggggatagctcggggaaactcgaattaataccgcatacggaaagttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggaagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtgggctagaatatgtgagagggaagtagaattccaggtgtagcggtgaaatgcgtagagatctggaggaataccgatggcgaaggcagcttcctggcataattgacactgagattcgaaagcgtgggtagcaaacaggattagataccctggtagtccacgccgtaaacgatgtctactagccgttggggctttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatatacaggtgctgcatggctgtcgtcagctcgtgtcgtgagatgttgggttaagtcccgcaacgagcgcaacccttttccttatttgccagcggccgggaactttaaggatactgccagtgacaaactggaggaaggcggggacgacgtcaagtcatcatggcccttacgaccagggctacacacgtgctacaatggtaggcagagggttgctacacagcgatgtgatgctaatctcaacctatcgtagtccggatggagtctgcaactcgactccagaagtcggaatcgctagtaatcgcagatcagaatgctgcggtgaatacgttcccgggccttgtacacaccg

SEQ ID NO: 1265 - DNA, 1402 bp, Morganella morganii
tcgggcggtaacagggagaagcttgcttctctgctgacgagcggcggacgggtgagtaatgtatggggatctgcctgatggcgggggataactactggaaacggtagctaataccgcataatgtcttcggaccaaagcgggggacctccgggcctcgcgccatcagatgaacccatatgggattagctagtaggtgaggtaacggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttcgggttgtaaagtactttcagtcgggaggaaggtggtaaggttaataaccttggcaattgacgttaccgacagaagaagcaccggctaactccgtgccagcagccgcggtaatacggagggtgcaagcgttaatcggaattactgggcgtaaagcgcacgcaggcggttgattgagtcagatgtgaaatccccgggcttaacccgggaattgcatctgatactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagacatggattggagccttcgggaactctgagacggttaacccgggaattgcatctgatagtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgtatacaaagggaagcgaccccgcgagggcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctccgggagggcgc

SEQ ID NO: 1266 - DNA, 1495 bp, Morganella sp. JB-T16
attgaacgctggcggcaggcctaacacatgcaagtcgggcggtaacagggagaagcttgcttctctgctgacgagcggcggacgggtgagtaatgtatggggatctgcctgatggagggggataactactggaaacggtagctaataccgcataatgtctccggaccaaagcgggggaccttcgggcctcgcaccatcagatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagtcgggaggaaggtgttgagtttaatatgctcagcaattgacgttaccgacagaagaagcaccggctaactccgtgccagcagccgcggtaatacggagggtgcaagcgttaatcggaattactgggcgtaaagcgcacgcaggcggttgattaagtcagatgtgaaatccccgggctcaacccgggaattgcatctgagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcrcgtaatggygggaactcaaaggagactgccggtgataaaccggaggaaggtggggatgacgtcaagtcatcatggcccttacgagtagggctacacacgtgctacaatggcgtatacaaagggaagcgacctcgcgagagcaagcggaactcacaaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacc

SEQ ID NO: 1267 - DNA, 1427 bp, Morococcus cerebrosus
atgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatg

SEQ ID NO: 1268 - DNA, 1331 bp, Moryella indoligenes
gcgtgcttaacacatgcaagtcgaacgagtggcggacgggtgagtaacgcgtggggaacctgcctcatacagggggataacagttggaaacgactgttaataccgcataagaaaaagtggtatgagatggacccgcgttcgattagccagttggcggggtaacggcccaccaaagcgacgatcgatagccgatttgagagaatgaccggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagatgacggtacctgagtaagaagccccggctaactacgtgccagcagccgcggtaatacgtagggggcaagcgttatccggatttactgggtgtaaagggagcgcagacggctatgcaagtctgaagtgaaagcccggggctcaaccccgggactgctttggaaactgtgtagctagagtgtcggagaggtaagcagaattcccagtgtagcggtgaaatgcgtagatattgggaagaataccggtggcgaaggcggcttactggacgaactgacgttcaggctcgaaggcgtggggagcaaacaggattagataccctggtagtccacgcggtaaacgatgaatactaggtgttggcatgtcggtgccgtcgcaaacgcaataagtattccacctggggagtacgttcgcaagaatgaaactcaaaggaattgacggggacccgcacaagcagtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctattgccagtagccagcagctgggcactctggcgagactgcctgggataaccaggaggaaggtggggatgacgtcaaatcatcatgccccttatgatttgggcaacacacgtgctacaatggcgtacagagagaagcgaaggagcgatccggagcgaatctaaaacgtctcagttcggatgcagtctgcaactcgactgcagaagctggaattgctagtaatcgcgaatcagcatgtcgcggtgaatacgttcccgggtcttgtacacaccgcccgtcacaccatgggagtcagcaacgcccgaagtcagtacccagggagctgccgaaggcggggcggataactggggtgaagtcgtaacaaggtagccgtatcggaaggtgcggttggatcacctcct

SEQ ID NO: 1269 - DNA, 1526 bp, Mycobacterium abscessus
ttttgtttggagagtttgatcctggctcaggacgaacgctggcggcgtgcttaacacatgcaagtcgaacggaaaggcccttcggggtactcgagtggcgaacgggtgagtaacacgtgggtgatctgccctgcactctgggataagcctgggaaactgggtctaataccggataggaccacacacttcatggtgagtggtgcaaagcttttgcggtgtgggatgagcccgcggcctatcagcttgttggtggggtaatggcccaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgaaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtatctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgtaaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctcctttctaagga

SEQ ID NO: 1270 - DNA, 1433 bp, Mycobacterium africanum
gacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaag

SEQ ID NO: 1271 - DNA, 1376 bp, Mycobacterium alsiensis
ttttgggagtttgatcctggctcaggacgaacgctggcggcgtgcttaacacatgcaagtcgaacgagtggcgaacgggtgagtaacacgtgggtaatctgccctgcacttcgggataagcctgggaaactgggtctaataccgaatagggaaaggcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgatgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcggccggggactcgtgagagactgccggggtcaactcggaggaaggtggggatgacgtcaagtcatcatgccccttatgtccagggcttcacacatgctacaatggccggcaaagggctgcgatgccgcaaggttaagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccagtgcctagggagctgtcgaaggtgggatcggcgattgggacgaagtcgtaacaaggtagccgtaccggaaggtgcggctggatcacctcctttct

SEQ ID NO: 1272 - DNA, 1537 bp, Mycobacterium avium
tttgtttggagagtttgatcctggctcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctcaagacgcatgtcttctggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttttgggagggagctgtcgaaggtgggatcggcgattgggacgaagtcgtaacaaggtagccgtaccggaaggtgcggctggatcacctcctttct

SEQ ID NO: 1273 - DNA, 1468 bp, Mycobacterium chelonae
gacgaacgctggcggcgtgcttaacacatgcaagtcgaacggaaaggcccttcggggtactcgagtggcgaacgggtgagtaacacgtgggtgatctgccctgcactctgggataagcctgggaaactgggtctaataccggataggaccacacacttcatggtgagtggtgcaaagcttttgcggtgtgggatgagcccgcggcctatcagcttgttggtggggtaatggcccaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagtagggacgaagcgaaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcgcaggacgtatctagagataggtattcccttgtggcctgcgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgcaaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaagg

SEQ ID NO: 1274 - DNA, 1481 bp, Mycobacterium colombiense
catgcaagtcgaacggaaaggcctcttcggaggtactcgagtggcgaacgggtgagtaacacgtgggcaatctgccctgcacttcgggataagcctgggaaactgggtctaataccggataggacctttagacgcatgtcttttggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaaggtagccgtaccggaaggtgcggctggatcacctccttttct

SEQ ID NO: 1275 - DNA, 1475 bp, Mycobacterium elephantis
agtttgatcctggctcaggacgaacgctggcggcgtgcttaacacatgcaagtcgaacggaaaggccccttcgggggtgctcgagtggcgaacgggtgagtaacacgtgggtgatctgccctgcactttgggataagcctgggaaactgggtctaataccgaatacaccctgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtatcgacgaagccgtgaggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtgatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgcaagggagggagccgtcgaaggtgggatcggcgattgggacgaagtcgtaac

SEQ ID NO: 1276 - DNA, 1485 bp, Mycobacterium gordonae
tagagtttgaatcatggctcaggacgaacgctggcggcgtgcttaacacatgcaagtcgaacggtaaggcccttcggggtacacgagtggcgaacgggtgagtaacacgtgggtaatctgccctgcacatcgggataagcctgggaaactgggtctaataccgaataggaccacagaacacatgtcctgtggtggaaagcttttgcggtgtgggatgggcccgcggcctatcagcttgttggtggggtgatggcccaccaaggcgacgacgggtagccggcctgagagggtgtccggccacactgggactgagatacggcccagactcctacgggaggcagcagtggggaatattgcacaatgggcgaaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacagagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaaca

SEQ ID NO: 1277 - DNA, 1495 bp, Mycobacterium intracellulare
agagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggacctttaggcgcatgtctttaggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgta

SEQ ID NO: 1278 - DNA, 1469 bp, Mycobacterium kansasii
gacgaacgctggcggcgtgcttaacacatgcaagtcgaacggaaaggtctcttcggagacactcgagtggcgaacgggtgagtaacacgtgggcaatctgccctgcacaccgggataagcctgggaaactgggtctaataccggataggaccacttggcgcatgccttgtggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggta

SEQ ID NO: 1279 - DNA, 1314 bp, Mycobacterium lacus
gacgaacgctggcggcgtgcttaacacatgcaagtcgaacgagtggcgaacgggtgagtaacacgtgggtgatctgccctgcacttcgggataagcctgggaaactgggtctaataccggatagggaaaggcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgatgacggtagatggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcggccggggactcgtgagagactgccggggtcaactcggaggaaggtggggatgacgtcaagtcatcatgccccttatgtccagggcttcacacatgctacaatggccggcaaagggctgcgatgccgcgaggttaagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccagtgcctagggagctgtcgaaggtgggatcggcgattgggacgaagtcgtaacaaggta

SEQ ID NO: 1280 - DNA, 1553 bp, Mycobacterium leprae
tttgtttggagagtttgatcctggctcaggacgaacgctggcggcgtgcttaacacatgcaagtcgaacggaaaggtctctaaaaaatcttttttagagatactcgagtggcgaacgggtgagtaacacgtgggtaatctgccctgcacttcagggataagcttgggaaactgggtctaataccggataggacttcaaggcgcatgtcttgtggtggaaagctttttgcggtgcaggatgggcccgcggcctatcagcttgttggtggggtgacggcctaccaaggcgacgacgggtagccggcctgagagggtgtacggccacactgggactgagatacggcccagactcctacgggaggcagcagtggggaatattgcacaatgggcgcaagcctgatgcagcgacgccgcgtgggggatgacggctttcgggttgtaaacctctttcaccatcgacgaaggtctgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccagtggcgaaggcgggtctctgggcagtaactgacgctgaggagcgaaagcgtggggagcaaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggatgcgtctagagataggcactcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccgcggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtccaaggtgggatcggcgattgggacgaagtcgtaacaaggtagccgtaccggaaggtgcggctggatcacctcctttctaagg

SEQ ID NO: 1281 - DNA, 1538 bp, Mycobacterium lepromatosis
agagtttgatcctggctcaggacgaacgctggcggcgtgcttaacacatgcaagtcgaacggaaaggtctcttaatacttaaacctattaaagatactcgagtggcgaacgggtgagtaacacgtgggtaatctaccctgcacttcagggataagcctgggaaaccgggtctaataccggataggacttcaaggcgcatgtcttgtggtggaaagcttttgcggtgcgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggctttcgggttgtaaacctctttcaccattgacgaagatctgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacggggcccgcacaagcggcggagcatgtggattaattcgatgcaacgcgaagaaccttacctgggtttgacatgcacaggacgcgtctagagataggcgttcctttttggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccgcggtcaactcggaggaaggtggggatgacgtcaagtcatcatgccccttatgtccagggcttcacacatgctacaatggccggtacaaagggctgcgatgccgcaaggttaagcgaatccttattaaagccggtctcagttcggatcggggtctgcaactcgaccccgtgaagccggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggttggatcacctcct

SEQ ID NO: 1282 - DNA, 1310 bp, Mycobacterium mageritense
gacgaacgctggcggcgtgcttaacacatgcaagtcgaacgagtggcgaacgggtgagtaacacgtgggtgatctgccctgcactttgggataagcctgggaaactgggtctaataccgaatagggaaaggcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcaagacgatgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagactgacgctgaggagcgaaagcgtggggagcgaacaggattagataccctggtagtccacgccgtaaacggtgggtactaggtgtgggttgatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgtgcaggtggtgcatggctgtcgtcagctcgtgtcgtgagatgttgggttaagtcccgcaacgagcgcaacccttgtctcatgttgccagcacgtggggactcgtgagagactgccggggtcaactcggaggaaggtggggatgacgtcaagtcatcatgccccttatgtccagggcttcacacatgctacaatggccggcaaagggctgcgatgccgtgaggtggagcgaatcctttccggtctcagttcggacggggtctgcaactcgaccccggaagtcggagtcgctagtaatcgcagatcagcaacgctgcggtgaatacgttcccgggccttgtacacaccgcccgtcacgtcatgaaagtcggtaacacccgaagccggtgcctagggagccgtcgaaggtgggatcggcgattgggacgaagtcgtaacaag

SEQ ID NO: 1283 - DNA, 1471 bp, Mycobacterium mantenii
tggttcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccgaataggaccacttggcgcatgccttgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggctcactttgtgggttgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaa

SEQ ID NO: 1284 - DNA, 1535 bp, Mycobacterium marinum
tttgtttggagagtttgatcctggctcaggacgaacgctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaaggtgcggctggatcacctcctttct

SEQ ID NO: 1285 - DNA, 1484 bp, Mycobacterium microti
gacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatgaccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaagg

SEQ ID NO: 1286 - DNA, 1273 bp, Mycobacterium neoaurum
tggcgaacgggtgagtaacacgtgggtgatctgccctgcactttgggataagcctgggaaactgggtctaataccgaatatgatcatcggcttcatggtcggtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgctggtagagatatcagttcccttgtggcctgtgtgcaggtggtgcatggctgtcgtcagctcgtgtcgtgagatgttgggttaagtcccgcaacgagcgcaacccttgtcctatgttgccagcgggttatgccggggactcgtaggagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggcct

SEQ ID NO: 1287 - DNA, 1523 bp, Mycobacterium parascrofulaceum
tttgtttggagagtttgatcctggctcaggacgaacgctggcggcgtgcttaacacatgcaagtcgaacggaaaggtctcttcggagatactcgagtggcgaacgggtgagtaacacgtgggcaatctgccctgcacttcgggataagcctgggaaactgggtctaataccggataggaccacttggcgcatgccttgtggtggaaagcttttgcggtgtgggatgggcccgcggcctatcagctagttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggtggtttgtcgcgttgttcgtgaaaaccgggggcttaaccctcggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattgggacgaagtcgtaacaaggtagccgtaccggaaggtgcggctggatcacctcctttct

SEQ ID NO: 1288 - DNA, 1417 bp, Mycobacterium paraterrae
tgcttaacacatgcaagtcgaacggaaaggccctttcgggggtactcgagtggcgaacgggtgagtaacacgtgggtgatctgccctgcactttgggataagcctgggaaactgggtctaataccgaataggaccacgcgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccaggattcttcttggggtgacagtaggtacagaagaagcaccggccaactacgtgccagcagccgcggtaatacgtagggtgcgagcgttgtccggaattactgggcgtaaagagctcgtaggtggtttgtcacgttgtccgtgaaaactcacagcttaactgtgggcgtgcgggcgatacgggcagactggagtactgtaggggagactggaattcctggtgtagcggtggaatgcgcagatatcaggaggaacaccggtggcgaaagcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgctgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcga

SEQ ID NO: 1289 - DNA, 1486 bp, Mycobacterium phlei
tagagtttgatcatggctcaggacgaacgctggcggcgtgcttaacacatgcaagtcgaacggaaaggccccttcgggggtactcgagtggcgaacgggtgagtaacacgtgggtgatctgccctgcactctgggataagcctgggaaactgggtctaataccggatacacccttctggttgcatggctgggaggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtagggacgaagcgtgagtgacggtacctacagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgacggcagagatgtcgtttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagaccgccggggtcaactcggaggaaggtggggatgacgtcaagtcatcatgccccttatgtccagggcttcacacatgctacaktggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggagccgc

SEQ ID NO: 1290 - DNA, 1522 bp, Mycobacterium seoulense
gagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccgaataggaccacttggcgcatgccttgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggtttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcgattggacgaagtcgtaacaaggtagccgtaccggaaggtgcggctggatcacctcctt

SEQ ID NO: 1291 - DNA, 1525 bp, Mycobacterium smegmatis
ttgtttggagagtttgatcctggctcaggacgaacgctggcggcgtgcttaacacatgcaagtcgaacggaaaggccctttcgggggtactcgagtggcgaacgggtgagtaacacgtgggtgatctgccctgcactttgggataagcctgggaaactgggtctaataccgaatacaccctgctggtcgcatggcctggtaggggaaagcttttgcggtgtgggatgggcccgcggcctatcagcttgttggtggggtgatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcacagacgaagcgcaagtgacggtatgtgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttct

SEQ ID NO: 1292 - DNA, 1478 bp, Mycobacterium sp. 1761
gaacgctggcggcgtgcttaacacatgcaagtcgaacgtgaaggcttccttcggcatagtcgagtggcgaacgggtgagtaacacgtgggtgatctgccctgcacttcgggataagcttgggaaactgggtctaataccggatagacgctgctacccgcatgccttttggtggaaagcttttgcggtgtgggatgggcccgcggcctatcagcttgttggtgaggtaacggcctaccaaggcgacgacgggtagccggcctgagagggtgtccggccacactgggactgagatacggcccagactcctaccgggagcagcagtggggaatattgcacaatgggcgcaagcctgatgcagcgacgccgcgtgggggatgacggccttcgggtggtaaacctctttcaccatcgacgaaggtcctggtcttctccgattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccatagctaacgcattaagtaccccgcctgaggagtacggccgcaaggctaaaactcaaaggaattgacgggggcccgcaccagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtttcatgttgccagcgggtaatgccggggactcgtgagagactgccggggtcaactcggaggaaggtggggatgacgtcaagtcatcatgccccttatgtccagggcttcacacatgctacaatggccggtacaaagggccgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacaccccgcccgtcacgtcatgaaagtcggtaacacccgaagccagtggcctaacccctccggagggagctgtcgaaggtgggatcggcgattgggacgaagtcgtaacaaggtagccgtaccgg

SEQ ID NO: 1293 - DNA, 1507 bp, Mycobacterium sp. 1776
ctggcggcgtgcttaacacatgcaagtcgaacggaaaggcccctttcggaaggtactcgagtggcgaacgggtgagtaacacgtgggtgatctgccctgcacttcgggataagcctgggaaactgggtctaataccggataggaccacctgtcgcatggtgtgtggtggaaagcttttgcggtgtgggatgggcccgcggcctatcaacttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgcgggttttctcctggtgacagtatgtggagaagaagcaccggccaactacgtgccagcagccgcggtaatacgtagggtgcaagcgttgtccggaattactgggcgtaaagagctcgtaggtggtttgtcccgttgttcgtgaaatgacacagcttaactgtgggcgtgcgggcgatacgggcatactgtagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttctttcctaaggatccgtgccgtagctaacgcattaaataccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaaccctcgtctcatgttgccagcgcgtgatggcggggactcgtgagagactgccggggtcaactcggaggaaggtggggatgacgtcaagtcatcatgccccttatgtccagggcttcacacatgctacaatggccggtacaaagggctgcgatgccgtgaggttaaaccaatccttgtaaagccggtctcagttcggatcggggtctgcaactcgaccccgtgaagtcgaagtcgctagtaatcgcagatcagcaacgctgcggtgaatacgttcccgggccttgtacacaccgcccgtcacgtcatgaaagtcggtaacacccgaagccggtggcctaacccgtttgggagggagccgtcgaaggtgggatcgacgattgggacgaagtcgtaacaaggtagccgtaccggaaggtgctgctgataaacccacctcaataaaa

SEQ ID NO: 1294 - DNA, 1487 bp, Mycobacterium sp. 1781
catgccgggctgctaccatgcaagtcgacggaaggcccctttcggggggtactcgagtggcgaacgggtgagtaacacgtgggtgatctgccctgcacttcgggataagcttgggaaactgggtctaataccggataggaccacatgtcgcatggtgtgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgcgggttttctcgtggtgacggtaggtggagaagaagcaccggccaactacgtgccagcagccgcggtaatacgtagggtgcgagcgttgtccggaattactgggcgtaaagagctcgtaggtggtttgtcgcgttgttcgtggaatgccacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggttctttcctaaggatccgtgccgtagctaacgcattaagtaccccgcctggggagtacggccgcaaggctaaaactcaaaggaattgacggggggcccgcacaagcggcgggagcatgtggattaattcgatgcaacgcggaagaacctttacctgggtttgacatgcacaggacgcgtctagagataggcgtttcccttgtggcctgtgtgcaggtggtgcatggctgtcgtcagctcgtgtcgtggagatgttgggttaaggtcccgcaacgaggcgcaacccttgtctcatgttgccagcgcgtgatgggcgggacctcgtggagaagactgcctggggtcacctcggaggaaggtgggggatgacgtccaagtcatcatgccccttatgtccagggcttcacacatgcctacaatggccggtacaaagggctgcgatgccgtgaggatttaagcgaatccttgttaaagctcggtcttcgagttcggaattcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgtttgggagggagccgtcgaaggtgggatcggcgattggacgaagtcgtaacaagtagcttca

SEQ ID NO: 1295 - DNA, 1472 bp, Mycobacterium sp. 1791
gaacgctggcggcgtgcttaacacatgcaagtcgaacggaaaggtccttcgggcctactcgagtggcgaacgggtgagtaacacgtgggcaatctgccctgcacttcgggataagcttgggaaactgggtctaataccgggtagaccgcgtcatgcatgtccggtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttccggttttcttcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagcccgtggcctaacccgttttggagggagctgtcgaaggtgggatcggcgattgggacgaagtcgtaacaaggtagccgt

SEQ ID NO: 1296 - DNA, 1486 bp, Mycobacterium sp. 1797
gaacgctggcggcgtgcttaacacatgcaagtcgaacgtgaaggcttccttcggcatagtcgagtggcgaacgggtgagtaacacgtgggtgatctgccctgcacttcgggataagcctgggaaactgggtctaataccggatagacgctgctacccgcatgccttgtggtggaaagcttttgcggtgtgggatgggcccgcggcctatcagcttgttggtgaggtaatggcttaccaaggcgacgacgggtagccggcctgagagggtgtccggccacactgggactgagatacggcccagactcctaccggaagcagcagtggggaatattgcacaatgggcgcaagcctgatgcagcgacgccgcgtgagggatgacggccttcgggttgtaaacctccttcaccatcgacgaatgatctgagtttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccctctctggagggagccgtcgaaggtgggatcggcgattgggacgaagtcgtaacaaggtagccgtaccggaaggt

SEQ ID NO: 1297 - DNA, 1328 bp, Mycobacterium sp. AQ1GA4
ggtgagtaacacgtgggtgatctgccctgcactttgggataagcctgggaaactgggtctaataccgaataggactccggactgcatggtctggggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcgcctacgacgaagcgtaagtgacggtagtaggagaagaagcaccggccaactacgtgccagcagccgcggtaatacgtagggtgcgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgactgcagagatgtggtttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatccttgttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttg

SEQ ID NO: 1298 - DNA, 1513 bp, Mycobacterium sp. B10-07.09.0206
gacgaacgctggcggcgtgcttaacacatgcaagtcgaacggaaaggcccykytygsrgggtgctcgagtggcgaacgggtgagtaacacgtgggtgatctgccctgcacttcgggataagcttgggaaactgggtctaataccggataggactccgagatgcatgtcttggggtggaaagctttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaagctgccgctttttgtggtggtgacggtaggtggagaagaagcaccggccaactacgtgccagcagccgcggtaatacgtagggtgcgagcgttgtccggaattactgggcgtaaagagctcgtaggtggtttgtcgcgttgttcgtgaaattccctggcttaactgggggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcwycyagagatrggkgttcccttgtggcctgtgtgcaggtggtgcatggctgtcgtcagctcgtgtcgtgagatgttgggttaagtcccgcaacgagcgcaacccttgtctcatgttgccagcgcgtgatggcggggactcgtgagagactgccggggtcaactcggaggaaggtggggatgacgtcaagtcatcatgccccttatgtccagggcttcacacatgctacaatggccggtacaaagggctgcgatgccgtgaggtttagcgaatcctttaaagccggtctcagttcggatcggggtctgcaactcgaccccgtgaagtcggagtcgctagtaatcgcagatcagcaatgctgcggtgaatacgttcccgggccttgtacacaccgcccgtcacgtcatgaaagtcggtaacacccgaagcccatggcctaacccgcaagggagggagtggtcgaaggtgggatcggcgattgggacgaagtcgtaacaaggtagccgtaccggaaggtgcggctggatcacctcctttctaa

SEQ ID NO: 1299 - DNA, 1402 bp, Mycobacterium sp. GN-10546
catgcaagtcgaacggaaaggccctttcgggggtactcgagtggcgaacgggtgagtaacacgtgggtgatctgccctgcactttgggataagcctgggaaactgggtctaataccgaataggaccgcatgcttcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccgggatttttcttggggtgacggtaggtacagaagaagcaccggccaactacgtgccagcagccgcggtaatacgtagggtgcgagcgttgtccggaattactgggcgtaaagagctcgtaggtggtttgtcacgttgtccgtgaaaactcacagcttaactgtgggcgtgcgggcgatacgggcagactggagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccagcagagatgttggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatcccgtgagggttagcgaatcctttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagc

SEQ ID NO: 1300 - DNA, 1390 bp, Mycobacterium sp. GN-10827
tgcaagtcgaacggaaaggccccttcgggggtgctcgagtggcgaacgggtgagtaacacgtgggtgatctgccctgcactttgggataagcctgggaaactgggtctaataccgaatacaccctgctggtcgcatggcctggtgggggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcagtatcgacgaagccgtgaggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtgatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccgcaagggagggagc

SEQ ID NO: 1301 - DNA, 1383 bp, Mycobacterium sp. GN-11124
tcgaacggaaaggccctttcgggggtgctcgagtggcgaacgggtgagtaacacgtgggtgatctgccctgcacttcgggataagcctgggaaactgggtctaataccggataggaccacggtctgcatggattgtggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacccctttcaatagggacgaagcgcaagtgacggtacctatagaagaagcaccggccaactacgtgccagcagccgcggtaatacgtagggtgcgagcgttgtccggaattactgggcgtaaagagctcgtaggtggtttgtcgcgttgtccgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccg

SEQ ID NO: 1302 - DNA, 1404 bp, Mycobacterium sp. GN-9188
catgcaagtcgaacggaaaggccctttcgggggtactcgagtggcgaacgggtgagtaacacgtgggtgatctgccctgcactttgggataagcctgggaaactgggtctaataccgaatatgatcatgcgcctcatggtgtgtggtggaaagcttttgcggtgtgggatgggcccgcggcctatcagcttgttggtggggtaatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcagtatcggcgaagctccagggttttctttggggtgacggtaggtacagaagaagcaccggccaactacgtgccagcagccgcggtaatacgtagggtgcgagcgttgtccggaattactgggcgtaaagagctcgtaggtggtttgtcgcgttgtccgtgaaaactcacagctcaactgtgggcgtgcgggcgatacgggcagactggagtactgtaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttcctttagggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggtagagatatcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgataccgtgaggtttagcgaatcctttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccg

SEQ ID NO: 1303 - DNA, 1386 bp, Mycobacterium sp. GR-2007-210
agtcgaacggaaaggcccttcggggtactcgagtggcgaacgggtgagtaacacgtgggtgatctgccctgcactttgggataagcctgggaaactgggtctaataccgaatacaccctgctggccgcatggtctggtgggggaaagcttttgcggtgtgggatgggcccgcggcctatcagcttgttggtgaggttacggctcaccaaggcgacgacgggtagccggcctgagagggtgatcggccacactgggactgagatacggcccagactcctacgggaggcagcagtggggaatattgcacaatgggcgcaagcctgatgcagcgacgccgcgtgggggatgacggccttcgggttgtaaacctctttcagtagggacgaagcgcaagtgacggtacctacagaagaaggaccggccaactacgtgccagcagccgcggtaatacgtagggtccgagcgttgtccggaattactgggcgtaaagagctcgtaggtggtttgtcgcgttgttcgtgaaaaccgggggcttaaccctcggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgt

SEQ ID NO: 1304 - DNA, 1484 bp, Mycobacterium sp. HE5
agagtttgatcctggctcaggacgaacgctggcggcgtgcttaacacatgcaagtcgaacggaaaggcccttcggggtactcgagtggcgaacgggtgagtaacacgtgggtgatctgccctgcactttgggataagcctgggaaactgggtctaataccgaataggaccgcatgcttcatggtgtgtggtggaaagcttttgcggtgtgggatgggcccgcggcctatcagcttgttggtggggtaatggcctaccaaggcgacgacgggtagccggcctgagagggtgaccggccacactgggactgagatacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaaggaccggccaactacgtgccagcagccgcggtaatacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgccggcagagatgtcggttcccttgtggcctgtgtgcaggtggtgcatggctgtcgtcagctcgtgtcgtgagatgttgggttaagtcccgcaacgagcgcaacccttgtctcatgttgccagcacgttatggcggggactcgtgagagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacactcgaagccggtggcctaaccccttgtgggagggagccgtcgaaggtgggatcggcgattgggacgaagtcgtaacaaggtagccgta

SEQ ID NO: 1305 - DNA, 1470 bp, Mycobacterium sp. NLA001000736
agtttgatcatggttcaggacgaacgctggcggcgtgcttaacacatgcaagtcgaacggaaaggccccttcgggggtgctcgagtggcgaacgggtgagtaacacgtgggtgatctgccctgcactctgggataagcctgggaaactgggtctaataccggataggaccgcgcatcgcatggtgtgtggtggaaagcttttgcggtgtgggatgggcccgcggcctatcagcttgttggtggggttatggcctaccaaggcgacgacgggtagccggcctgagagggtgtccggccacactgggactgagatacggcccagactcctacgggaggcagcagtggggaatattgcacaatgggcggaagcctgatgcagcgacgccgcgtgagggatgacggccttcgggttgtaaacctctttcagcctcgacgaagcgcaagtgacggtaggggcagaagaagcaccggccaactacgtgccagcagccgcggtaatacgtagggtgcgagcgttgtccggaattactgggcgtaaagagctcgtaggtggtttgtcgcgtcgtccgtgaaatcccatggcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgactgcagagatgtggtttcccttgtggyctgtgtacaggtggtgcatggctgtcgtcagctcgtgtcgtgagatgttgggttaagtcccgcaacgagcgcaacccttgttccatgttgccagcgcgtaatggcggggactcatgggagactgccggggtcaactcggaggaaggtggggatgacgtcaagtcatcatgccccttatgtccagggcttcacacatgctacaatggccggtacaaagggctgcgatgccgtgaggtggagcgaatcctttcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggggggagctgtcgaaggtgggatcggcgattgggacgaagtcgtaac

SEQ ID NO: 1306 - DNA, 1465 bp, Mycobacterium sp. W
gagagtttgatcctggctcaggacgaacgctggcggcgtgcttaacacatgcaagtcgaacggaaaggccccttcgggggtactcgagtggcgaacgggtgagtaacacgtgggcaatctgccctgcacttcgggataagcctgggaaactgggtctaataccggataggacctttaggcgcatgtctttaggtggaaagcttttgcggtgtgggatgggcccgcggcctatcagcttgttggtggggtgatggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttgggagggagctgtcgaaggtgggatcggcg

SEQ ID NO: 1307 - DNA, 1540 bp, Mycobacterium tuberculosis
tttgtttggagagtttgatcctggctcaggacgaacgctggcggcgtgcttaacacatgcaagtcgaacggaaaggtctcttcggagatactcgagtggcgaacgggtgagtaacacgtgggtgatctgccctgcacttcgggataagcctgggaaactgggtctaataccggataggaccacgggatgcatgtcttgtggtggaaagcgctttagcggtgtgggatgagcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttctctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtacaaagggctgcgatgccgcgaggttaagcgaatccttaaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctcgggagggagctgtcgaaggtgggatcggcgattgggacgaagtcgtaacaaggtagccgtaccggaaggtgcggctggatcacctcctttctaagg

SEQ ID NO: 1308 - DNA, 1475 bp, Mycobacterium ulcerans
ctggcggcgtgcttaacacatgcaagtcgaacggaaaggtctcttcggagatactcgagtggcgaacgggtgagtaacacgtgggcgatctgccctgcacttcgggataagcctgggaaactgggtctaataccggataggaccacgggattcatgtcctgtggtggaaagcttttgcggtgtgggatgggcccgcggcctatcagcttgttggtggggtaacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggccggtgcaaagggctgcgatgccgcgaggttaagcgaatcctttaacgccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaccctttgggagggagctgtcgaaggtgggatcggcgattgggacgaagtcgtaacaaggtagccgtaccggaagg

SEQ ID NO: 1309 - DNA, 1471 bp, Mycobacterium vulneris
gttcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctttagacgcatgtcttttggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggttcgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgcaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaaccttttggagggagctgtcgaaggtgggatcggcgattgggacgaagtcgtaacaa

SEQ ID NO: 1310 - DNA, 1346 bp, Mycoplasma agalactiae
gatgaacgctggctgtgtgcctaatacatgcatgtcgagcgatgatagcaatatcatagcggcgaatgggtgagtaacacgtactcaacgtaccttttagattgggatagcggatggaaacatccgataataccgaatacttattatttttgcatgaaagtaatataaaaggaagcgtttgcttcgctagaagatcggagtgcgcaacattagctagttggtgaggtaacggcccaccaaggcgatgatgtttagcggggttgagagattgatccgccacactgggactgagatacggcccagactcctacgggaggcagcagtagggaatattccacaatggacgaaagtctgatggagcgacacagcgtgcaggatgaaggccctatgggttgtaaactgctgtggttagggaagaaaaagtagcgtaggaaatgacgctaccttgacggtacctgattagaaagcaacggctaactatgtgccagcagccgcggtaatacataggttgcaagcgttatccgaaattattgggcgtaaagcgtctgtaggttgtttgttaagtctggcgttaaattttggggctcaaccccaaaacgcgttggatactggcagactagagttatgtagaggttagcggaattccttgtgaagcggtgaaatgcgtagatataaggaagaacatcaatatggcgaaggcagctaactgggcatacactgacactgagagacgaaagcgtggggagcaaacaggattagataccctggtagtccacgccctaaacgatgatcattagttgatggggaactcatcgacgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgttcggttaagtcctgcaacgagcgcaacccttatccttagttactaccatttagttgagcactctaaggagactgcccgagtaatcgggaggaaggtggggacgacgtcaaatcatcatgcctcttacgagtggggctacacacgtgctacaatggacggtacaaagagaagcgaagtggtgacatggagcaaacctcaaaaaaccgttctcagttcggattgaagtctgcaactcgacttcatgaagtcggaatcgctagtaatcgtagatcagctacgctacggtgaatacgttctcgggtctt

SEQ ID NO: 1311 - DNA, 1339 bp, Mycoplasma amphoriforme
ttgatcctggctcaggattaacgctggcggcatgcctaatacatgcaagtcgatcgagaggcgaacgggtgagtaacacgtatccaatttaccccatagcggggataactagtcgaaagattagctaataccgcataactaaagttactatgggataagggtgcggcatatcagctagttggtgaggtaacggcccaccaaggcaatgacgtgtagttatgctgagaggtagaataaccacaatggaactgagacacggtccatactcctacgggaggcagcagtagggaatttttcacaatggacgaaagtctgatggagcaatgccgcgtgaacgatgaaggtcttgtgattgtaaagttcttttatttaggaagatgaccgtactatttgaataagtaacgactaactatgtgccagcagtcgcggtaatacataggttgcaagcgttatccggatttattgggcgtaaaacaagcgcaggcggattagaaagtctggtgttaaaatcactgcttaacggttgaatgcattggaaacttctagtctagagtgtggtagagagttctggaactccatgtggagcggtggaatgcgtagatatatggaagaacaccagctgcgaaggcgagaacttaggccaactgacgcttaggcttgaaagtgtggggagcaaataggattagataccctagtagtccacaccgtaaacgatggatgttaaacgtcggggcctcggtgttgcagttaacacattaaacatcctgcctgggtagtacattcgcaagaatgaaactcaaaggaattgacggggacccgcacaagtggtggagcatgttgcttaattcgacggtacacgaaaaaccttacctagacttgacatcgacaggtggtgcatggttgtcgtcagctcgtgtcgtgagatgttgggttaagtccgcaacgcgcaacccttatcgttagttatctaacgagactgccaacgcaagttggaggaaggtggggatgacgtcaaatcatcatgccttatgtctagggctgcaaacgtgctacaatggccaacaaacagttaccaaaccgtaaggtggtgagtatctgcttggtctcagttcggatgagggctgcaattcgccctcagaagtcggaatcactagtaatcgcgaatcagctatgtcgcggtgaatacgttctcgggtcttgtacacaccgcccgtcaaactacgagagttgatagtgtctaaaaccgtgtgctaagcgcatgtctaggacaagattaatgattggagttaagtcgtaacaaggtacccctacgagaacgtgggggtggatcacctccttt

SEQ ID NO: 1312 - DNA, 1525 bp, Mycoplasma arthritidis
atatttttaagagtttgatcctggctcaggatgaacgctggctgtgtgcctaatacatgcatgtcgagcggaagtagcaatactttagcggcgaatgggtgagtaacacgtgcttaatctaccctttagactggaataactaatggaaacattggctaatgccggatgcgcatggaatcgcatgattccgttgtgaaaggagcctcaaagctccactagaggatgagggtgcggaacattagcttgttggtgaggtaacggcccaccaaggcaatgatgtttagccgggtcgagagactgaacggccacattgggactgagatacggcccaaactcctacgggaggcagcagtagggaatattccacaatgagcgaaagcttgatggagcgacacagcgtgcacgatgacggtcttcggattgtaaagtgctgttataggggaagaacacttagttgaggaaatgcttctaagctgacggtaccctgtcagaaagcgatggctaactatgtgccagcagccgcggtaatacataggtcgcaagcgttatccggaattattgggcgtaaagcgttcgtaggctgtttattaagtctggagttaaatcccagggctcaaccctggctcgctttggatactggtaaactagagttagatagaggtaagcggaattccatgtgaagcggtgaaatgcgtagatatatggaagaacaccaaaggcgaaggcagcttgctgggtctatactgacgctgagggacgaaagcgtggggagcaaacaggattagataccctggtagtccacgccgtaaacgatgatcattagtcggtggattaatcactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatccttcgcaaagctatagagatatagtggaggttaacggagtgacagatggtgcatggttgtcgtcagctcgtgtcgtgagatgtttggtcaagtcctgcaacgagcgcaacccctatctttagttactaacgagtcatgtcgaggactctagagatactgcctgggtaactgggaggaaggtggggatgacgtcaaatcatcatgcctcttacgagtggggcaacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtggggatggatcacctcctttct

SEQ ID NO: 1313 - DNA, 1474 bp, Mycoplasma bovoculi
ctcgctgtgtgcctaatacatgcatgttgaacggaatattttagcttgctaaaatatttagtagcgaatgggtgagtaacacgtacctaatctacctttaggttcgggataacttttggaaacaagagctaatacctgatatagtttattttcgcatgaagataaataaaaaggagcttcacggcttcgcctagaaatgagggtgcggaacattagttagttggtgaggtaatggctcaccaagacgatgatgtttagcggggccaagaggttgtaccgccacactgggactgagatacggcccagactcctacgggaggcagcagtaaggaattttccacaatgagcgaaagcttgatggagcgacacagcgtgcacgatgaagtctttagggatgtaaagtgctgttataaggaaagaaaaaattaaataggaaatgatttaatcttgacggtaccttattagaaagcgacggcaaactatgtgccagcagccgcggtaatacataggtcgcaagcgttatccggaattattgggcgtaaagcgtccgtaggtgttttgttaagtttaaggttaaatactgaagctcaacttcagcccgctttagatactggcaaaatagaattatgaagaggttagcggaattcctagtggagcggtggaatgcgtagatattaggaagaacaccaataggcgaaggcagctaactggtcataaattgacactaagggacgaaagcgtggggagcaaacaggattagataccctggtagtccacgctgtaaacgatgatcattagttggtggtaataatcactagcacagctaacgcgataaatgatccgcctgagtagtatgctcgcaagagtgaaacttaaaggaattgacgggaacccgcacaagcggtggagcatgtggtttaatttgaagatacgcggagaaccttacccactcttgacatccttgcaaagctatagagatatagtagaggttaacaagatgacagatggtgcatggttgtcgtcagctcgtgtcgtgagatgttaggttaagtcctgcaacgagcgcaacccctttctttagttactaacattaagttgaggactctagagacactgccagcgtaagctggaggaaggtggggatgacgtcaaatcatcatgcctcttacgagtggggcaacacacgtgctacaatggctactacaaagagaagcaaaacggtgacgtccagcaaatctcaaaaaagtagtcccagttcggattgaagtctgcaactcgacttcatgaagtcggaatcgctagtaatcgcaggtcagctatactgcggtgaatacgttctcgggttttgtacacaccgcccgtcacaccatgggagttggtaatacccaaagtcggttagttaacttcggagactgctgcctaaggtaggactgatgactggggtgaagtcgtaacaaggtatccctacgagaac

SEQ ID NO: 1314 - DNA, 1459 bp, Mycoplasma faucium
ctggctgtgtgcctaatacatgcatgtcgagcggaagtagcaatactttagcggcgaatgggtgagtaacacgtgcttaatctaccttttagattggaatacctaatggaaacattggttaatgccggatacgcatgaaatcgcatgatttcgttgtgaaaggagcgtttgctccgctaaaagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaacacttagttgaggaaatgcaactaagctgacggtaccttgttagaaagcgatggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttggatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtgggagccactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatcctttgcaaagctatagagatatagtggaggttaacagagtgacagatggtgcatggttgtcgtcagctcgtgtcgtgagatgtttggtcaagtcctgcaacgagcgcaacccctatctttagttactaacgagtcatgttgaggactctagagatactgcctgggtaactgggaggaaggtggggatgacgtcaaatcatcatgcctcttacgagtggggcaacacacgtgctacaatggtcggtacaaagagacgcaatacggtgacgtggagcaaatctcaaaaagccgatctcagttcggattgaagtctgcaattcgacttcatgaagtcggaatcgctagtaatcgcagatcagctatgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaa

SEQ ID NO: 1315 - DNA, 1517 bp, Mycoplasma fermentans
attttttcgagagtttgatcctggctcaggatgaacgctggctgtgtgcctaatacatgcatgtcgagcgaaggtagcaataccttagcggcgaatgggtgagtaacacgtgctcaacgtacccttcagtttggcatagcgactggaaacagtcgataatttcaaatactcgtagttttcgcatgaagattacggaaaagaagcgtttgcttcgctggaggagcggggtgcgtaacattagctagttggtgaggtaacggcccaccaaggcgatgatgtttagcggggttgagagactgaaccgccacactgggactgagatacggcccagactcctacgggaggcagcagtagggaatattccacaatgggcgaaagcctgatggagcgacacagcgtgaaggatgaaggtcctatggattgtaaacttctgtggtaagggaagaaaagacagaataggaaatgattttgttttgacggtaccttattagaaagcaacggctaactatgtgccagcagccgcggtaatacataggttgcaagcgttatccggaattattgggcgtaaagcgtctgtaggttgtttgttaagtctggcgttaaattttggggctcaaccccaaaacgcgttggatactggcaggctagagttgtgtagaggttagcggaattccttgtgaagcggtgaaatgcgtagatataaggaagaacaccaagatggcgaaggcagctaactggacatatactgacactgagagacgaaagcgtggggagcaaacaggattagataccctggtagtccacgccctaaacgatgatcattagctgatggggaactcatcggcgcagctaacgcattaaatgatccgcctgagtagtacgttcgcaagaataaaacttaaaggaattgacggggatccgcacaagcggtggagcatgtggtttaatttgaagatacgcgtagaaccttacccactcttgacatcttctgcaaagctatggagacatagtggaggttaacagaatgacagatggtgcatggttgtcgtcagctcgtgtcgtgagatgtttggttaagtcctgcaacgagcgcaacccttatccttagttactaccattcagttgaggactctaaggagactgcccgagtaatcgggaggaaggtggggatgacgtcaaatcatcatgcctcttacgagtggggcaacacacgtgctacaatggccggtacaaagagaagcgaagtggtgacatggagcaaacctcaaaaaaccggtctcagttcggattgtagtctgcaactcgactacatgaagtcggaatcgctagtaatcgtagatcagctacgctacggtgaatacgttctcgggtcttgtacacaccgcccgtcaaaccatgggagctggtaatgcccgaagtcggtttataaacaaactgcctaaggcaggactggtgactggggttaagtcgtaacaaggtatccctacgagaacgtggggatggatcacctcctttct

SEQ ID NO: 1316 - DNA, 1545 bp, Mycoplasma flocculare
gcaatcatgagagtttgatcctagctcaggatgaacgctagctgtgtgcttaatacatgcatttgaacgggatagtattttagttttactaaagtattgttttagtagcaaatgggtgagtaacacgtacctaacctaccttttggactgggataaccattggaaacagtggctaataccggatataataaaaattcacatgaatttttatgaaaaggagcgaaaataagctccaccaaaaaatgggggtgcgcaacattagttagttggtagggtaaaggcctaccaagacgatgatgtttagcggggccaagaggttgtaccgccacactgggattgagatacggcccagactcctacgggaggcagcagtaaggaatattccacaatgagcgaaagcttgatggagcgacacagcgtgcaggatgaagtctttaggtatgtaaactgctgttgtaagggaagaaaaaaattaggtagggaatgatctaatcttgacggtaccttactagaaagcgacggcaaactatgtgccagcagccgcggtaatacataggtcgcaagcgttatccggaattattgggcgtaaagcgttcgtaggttttttgttaagtttaaggttaaatgctaaagctcaactttagtccgctttagatactggcaaaatagaattatgaagaggttagcggaattcctagtggagtggtggaatacgtagatattaggaagaacaccaataggcgaaggcagctaactggtcatatattgacactgagggacgaaagcgtggggagcaaacaggattagataccctggtagtccacgccgtaaacgatgatcattagttggtggcagaagtcactagcgcagctaacgcgttaaatgatccgcctgagtagtatgctcgcaagagtgaaacttaaaggaattgacgggaacccgcacaagcggtggagcatgtggtttaatttgaggatacgcgtagaaccttacccactcttgacattctcgcaaaactatagagatatagcggaggctaacgagattacagatggtgcatggttgtcgtcagctcgtgtcgtgagatgttaggttaagtcctgcaacgagcgcaacccttttctttagttgctaacattaagttgagaaccctagagatactgccggtgtaaaccggaggaaggtggggatgacgtcaaatcatcatgcctcttacgagtggggcaacacacgtgctacaatggctactacaaagagcagcaaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacctcggagaccattgcctaaggcaggaccgatgactggggtgaagtcgtaacaaggtatccctacgagaacgtggggatggaacacctcctttct

SEQ ID NO: 1317 - DNA, 1521 bp, Mycoplasma genitalium
ttttttctgagagtttgatcctggctcaggattaacgctggcggcatgcctaatacatgcaagtcgatcggaagtagcaatactttagaggcgaacgggtgagtaacacgtatccaatctaccttataatgggggataactagttgaaaaactagctaataccgcataagaactttagttcgcatgaattaaagttgaaaggacctgcaagggttcgttatttgatgagggtgcgccatatcagctagttggtagggtaatggcctaccaaggcaatgacgtgtagctatgctgagaagtagaatagccacaatgggactgagacacggcccatactcctacgggaggcagcagtagggaatttttcacaatgagcgaaagcttgatggagcaatgccgcgtgaacgatgaaggtctttttgattgtaaagttcttttatttgggaagaatgactctagcaggcaatggctggagtttgactgtaccactttgaataagtgacgactaactatgtgccagcagtcgcggtaatacataggtcgcaagcgttatccggatttattgggcgtaaagcaagcgcaggcggattgaaaagtctggtgttaaaggcagctgcttaacagttgtatgcattggaaactatcagtctagagtgtggtagggagttttggaatttcatgtggagcggtgaaatgcgtagatatatgaaggaacaccagtggcgaaggcgaaaacttaggccattactgacgcttaggcttgaaagtgtggggagcaaataggattagataccctagtagtccacaccgtaaacgatagatactagctgtcggagcgatcccttcggtagtgaagttaacacattaagtatctcgcctgggtagtacattcgcaagaatgaaactcaaacggaattgacggggacccgcacaagtggtggagcatgttgcttaattcgacggtacacgaaaaaccttacctagacttgacatccttggcaaagttatggaaacataatggaggttaaccgagtgacaggtggtgcatggttgtcgtcagctcgtgtcgtgagatgttgggttaagtcccgcaacgagcgcaacccttatcgttagttacattgtttaacgagactgctaatgtaaattggaggaaggaagggatgacgtcaaatcatcatgccccttatgtctagggctgcaaacgtgctacaatggccaatacaaacagtagccaacttgtaaaagtgagcaaatctgaaaagttggtctcagttcggattgagggctgcaattcgtcctcatgaagctggaatcactagtaatcgcgaatcagctatgtcgcggtgaatacgttctcgggtcttgtacacaccgcccgtcaaactatgaaagctggtaatatttaaaaacgtgttgctaacctttattggaagcgcatgtcaaggatagcaccggtgattggagttaagtcgtaacaaggtacccctacgagaacgtgggggtggatcacctcctttc

SEQ ID NO: 1318 - DNA, 1521 bp, Mycoplasma hominis
tttttataagagtttgatcctggctcaggatgaacgctggctgtgtgcctaatacatgcatgtcgagcgaggttagcaataacctagcggcgaatgggtgagtaacacgtgcttaatctaccttttagattggaatacccattggaaacaatggctaatgccggatacgcatggaaccgcatggttccgttgtgaaaggcgctgtaaggcgccactaaaagatgagggtgcggaacattagttagttggtgaggtaatggcccaccaagactatgatgtttagccgggtcgagagactgaacggccacattgggactgagatacggcccaaactcctacgggaggcagcagtagggaatattccacaatgagcgaaagcttgatggagcgacacagcgtgcacgatgaaggtcttcggattgtaaagtgctgttataagggaagaacatttgcaataggaaatgattgcagactgacggtaccttgtcagaaagcgatggctaactatgtgccagcagccgcggtaatacataggtcgcaagcgttatccggaattattgggcgtaaagcgttcgtaggctgtttgttaagtctggagttaaatcccggggctcaaccccggctcgctttggatactagcaaactagagttagatagaggtaagcggaattccatgtgaagcggtgaaatgcgtagatatatggaagaacaccaaaggcgaaggcagcttactgggtctatactgacgctgagggacgaaagcgtggggagcaaacaggattagataccctggtagtccacgccgtaaacgatgatcattagtcggtggagaatcactgacgcagctaacgcattaaatgatccgcctgagtagtatgctcgcaagagtgaaacttaaaggaattgacggggacccgcacaagcggtggagcatgtggtttaatttgaagatacacggaaaaccttacccactcttgacatccttcgcaaagctatagagatatagtggaggttatcggagtgacagatggtgcatggttgtcgtcagctcgtgtcgtgagatgtttggtcaagtcctgcaacgagcgcaacccctatctttagttactaacattaagttgaggactctagagatactgcctgggtaactgggaggaaggtggggatgacgtcaaatcatcatgcctcttacgagtggggccacacacgtgctacaatggtcggtacaaagagaagcaatatggcgacatggagcaaatctcaaaaagccgatctcagttcggattggagtctgcaattcgactccatgaagtcggaatcgctagtaatcgcagatcagctatgctgcggtgaatacgttctcgggtcttgtacacaccgcccgtcacaccatgggagctggtaatacccaaagtcggtttgctaacctcggaggcgaccgcctaaggtaggactggtgactggggtgaagtcgtaacaaggtatccctacgagaacgtggggatggatcacctcctttct

SEQ ID NO: 1319 - DNA, 1510 bp, Mycoplasma orale
agagtttgatcctggctcaggatgaacgctggctgtgtgcctaatacatgcatgtcgagcggaagtagcaatactttagcggcgaatgggtgagtaacacgtgcttaatctaccttttagattggaatacctaatggaaacattggttaatgccggatacgcatgaagtcgcatgacttcgttgtgaaaggagcgtttgctccgctaagagatgagggtgcggaacattagctagttggtgaggtaatggcccaccaaggctatgatgtttagccgggtcgagagactgaacggccacattgggactgagatacggcccaaactcctacgggaggcagcagtagggaatattccacaatgagcgaaagcttgatggagcgacacagcgtgcacgatgaaggccctcgggttgtaaagtgctgttgcaagggaagaacagttagttgaggaaatgcttctaatctgacggtaccttgttagaaagcgacggctaactatgtgccagcagccgcggtaatacataggtcgcaagcgttatccggaattattgggcgtaaagcgttcgtaggctgtttattaagtctggagtcaaatcccagggctcaaccctggctcgctttggatactggtaaactagagttagatagaggtaagcggaattccatgtggagcggtgaaatgcgtagatatatggaagaacaccaaaggcgaaggcagcttactgggtctatactgacgctgagggacgaaagcgtggggagcaaacaggattagataccctggtagtccacgctgtaaacgatgatcattagtcggtggaaaactactgacgcagctaacgcattaaatgatccgcctgagtagtatgctcgcaagagtgaaacttaaaggaattgacggggacccgcacaagcggtggagcatgtggtttaatttgaagatacgcggagaaccttacccactcttgacatcccctgcaaagctatagagatatagtagaggttaacagggtgacagatggtgcatggttgtcgtcagctcgtgtcgtgagatgtttggtcaagtcctgcaacgagcgcaacccctatctttagttactaacgagtcatgtcgaggactctagagatactgcctgggtaaccgggaggaaggtggggatgacgtcaaatcatcatgcctcttacgagtggggctacacacgtgctacaatggtcggtacaaagagaagcaatatggcgacatggagcaaatctcaaaaagccgatctcagttcggattgaagtctgcaattcgacttcatgaagtcggaatcgctagtaatcgcagatcagctacgctgcggtgaatacgttctcgggtcttgtacacaccgcccgtcacaccatgggagctggtaatacccaaagtcggtttgctaacctcggaggcgactgcctaaggtaggactggtgactggggtgaagtcgtaacaaggtatccctacgagaacgtgcggctggatcacctcctt

SEQ ID NO: 1320 - DNA, 1475 bp, Mycoplasma ovipneumoniae
ctatctgtgtgcttaatacatgcatgttgaacggaatatgttagcttgctaatatatttagtagcaaatgggtgagtaacacgtacctaacctaccttttggaccgggataaccattggaaacagcggctaataccagatacgataaaaaaatgcatgtttttttattaaaagaagcctttaaagcttcaccaaaaaatgggggtgcgcaacattagttagttggtagggtaaaggcctaccaagacgatgatgtttagcggggccaagaggctgtaccgccacactgggattgagatacggcccagactcctacgggaggcagcagtaaggaatattccacaatgagcgaaagcttgatggagcgacacagagtgcaggatgaagtctttagggatgtaaactgctgttgtaagggaagaaaaaactagataggaaatgatttagtcttgacggtaccttattagaaagtgacggcaaactatgtgccagcagccgcggtaatacataggtcgcaagcgttatccggaattattgggcgtaaagcgtccgcaggttttttgttaagtttaaggttaaatgctaaagctcaactttagttcgctttagatactgacaaaatagaattatgaagaggttagcggaattcctagtggagcggtggaatgcgtagatattaggaagaacaccaataggcgaaggcagctaactggtcatatattgacactaatggacgaaagcgtggggagcaaacaggattagataccctggtagtccacgccgtaaacgatgatcattagttggtggcaaaagtcactagcacagctaacgcgttaaatgatccgcctgagtagtatgctcgcaagagtgaaacttaaaggaattgacgggaacccgcacaagcggtggagcatgtggtttaatttgaagatacgcgtagaaccttacccactcttgacatcctcgcaaaactatagagatatagcggaggctaacgagatgacagatggtgcatggttgtcgtcagctcgtgtcgtgagatgttaggttaagtcctgcaacgagcgcaacccttttctttagttgctaacattaagttgagaaccctagagatactgccggtgcaaaccggaggaaggcggggatgacgtcaaatcatcatgcctcttacgagtggggcaacacacgtgctacaatggctactacaaagagcagcgaaacagtgatgtcaagctaatctcaaaaaagtagtctcagttcggattgaagtctgcaactcgacttcatgaagtcggaatcgctagtaatcgcaggtcagctatactgcggtgaatacgttctcgggttttgtacacaccgcccgtcacaccatgggagttggtaatgcccaaagtcggtgagttaacctcggagaccattacctaaggcaggaccgatgactggggtgaagtcgtaacaaggtatccctacgagaac

SEQ ID NO: 1321 - DNA, 1516 bp, Mycoplasma penetrans
tcaattttaagagtttgatcctggctcaggattaacgctagcgggatgcctaatacatgcaagtcggacgaagcacttgtgcttagtggcgaacgggtgagtaacacgtatctaacataccttttagtgggggataactggttgaaaaactagctaataccgcataggacattactatcgcatgagaaaatgtttaaagttgcgtttgcaacgctttaagattgaggtgtggcatatcagatagttggtagggtaacggcctaccaagtctatgacgtgtagctgtgctgagaggcaaaacagccacaatggaactgagacacggtccatacttctacgggaggcagcagtagggaatttttcacaatgggcgcaagcctgatggagcaatcccgcgtgaacgacgaaggttttttaaattgtaaagttcttttattggggacgaattgtaagaagaggaaatgctttttatttgactgtaccctttgaataagtatcggctaactatgtgccagcagccgcggtaatacataggatgcaagcgttatccggatttactgggcgtaaagcgagcgcaggcggatttacaagtctggtgttaaatatagctgcccaacagttatatgcattggaaactgtaagtctagagtgcagtagagagttttggaactccatgtggagcggtggaatgcgtagatatatggaagaacaccagaggcgaaggcgaaaacttaggctgttactgacgcttaggctcgaaagtgtggggagcaaataggattagataccctagtagtccacaccgtaaacgatggtaattaaatcttggtacgggatgtatcaggattgcagttaacacattaaattacccgcctgggtagtacattcgcaagaatgaaactcaaacggaattgacggggacccgcacaagtggtggagcatgttgcttaattcgacgatacacgtaaaaccttacctgggtttgacatcctctgcaaagctatagagatatagtggaggttaacagagtgacaggtggtgcatggttgtcgtcagctcgtgtcgtgagatgttgggttaagtcccgcaacgagcgcaacccttatcgttagttacttcatctagcgagactgccagcgtaagctggaggaaggtggggatgacgtcaaatcatcatgccctttatatccagggccgcaaacgtgctacaatggtcggtacaaactgttgccaatcagcaatgaggagctaatcagagaaagccgatctcagttcggatcgagggctgcaattcgtcctcgtgaagttggaatcactagtaatcgcaaatcagccatgttgcggtgaatacgttctcgggtcttgtacacaccgcccgtcaaactatgagagctggtaatacctaaaaccgttaagctaacctcgtgaggcttgcgtctagggtaggactggtaattggagttaagtcgtaacaaggtacccctacgggaatgtgggggtggatcacctcctttct

SEQ ID NO: 1322 - DNA, 1559 bp, Mycoplasma pneumoniae
tgttctttcaaaactggatgcaatctgtcaatttttctgagagtttgatcctggctcaggattaacgctggcggcatgcctaatacatgcaagtcgatcgaaagtagtaatactttagaggcgaacgggtgagtaacacgtatccaatctaccttataatgggggataactagttgaaagactagctaataccgcataagaactttggttcgcatgaatcaaagttgaaaggacctgcaagggttcgttatttgatgagggtgcgccatatcagctagttggtggggtaacggcctaccaaggcaatgacgtgtagctatgctgagaagtagaatagccacaatgggactgagacacggcccatactcctacgggaggcagcagtagggaatttttcacaatgagcgaaagcttgatggagcaatgccgcgtgaacgatgaaggtctttaagattgtaaagttcttttatttgggaagaatgactttagcaggtaatggctagagtttgactgtaccattttgaataagtgacgactaactatgtgccagcagtcgcggtaatacataggtcgcaagcgttatccggatttattgggcgtaaagcaagcgcaggcggattgaaaagtctggtgttaaaggcagctgcttaacagttgtatgcattggaaactattaatctagagtgtggtagggagttttggaatttcatgtggagcggtgaaatgcgtagatatatgaaggaacaccagtggcgaaggcgaaaacttaggccattactgacgcttaggcttgaaagtgtggggagcaaataggattagataccctagtagtccacaccgtaaacgatagatactagctgtcggggcgatcccctcggtagtgaagttaacacattaagtatctcgcctgggtagtacattcgcaagaatgaaactcaaacggaattgacggggacccgcacaagtggtggagcatgttgcttaattcgacggtacacgaaaaaccttacctagacttgacatccttggcaaagttatggaaacataatggaggttaaccgagtgacaggtggtgcatggttgtcgtcagctcgtgtcgtgagatgttgggttaagtcccgcaacgagcgcaacccttatcgttagttacattgtctagcgagactgctaatgcaaattggaggaaggaagggatgacgtcaaatcatcatgccccttatgtctagggctgcaaacgtgctacaatggccaatacaaacagtcgccagcttgtaaaagtgagcaaatctgtaaagttggtctcagttcggattgagggctgcaattcgtcctcatgaagtcggaatcactagtaatcgcgaatcagctatgtcgcggtgaatacgttctcgggtcttgtacacaccgcccgtcaaactatgaaagctggtaatatttaaaaacgtgttgctaaccattaggaagcgcatgtcaaggatagcaccggtgattggagttaagtcgtaacaaggtacccctacgagaacgtgggggtggatcacctcctttctaatggagtt

SEQ ID NO: 1323 - DNA, 1466 bp, Mycoplasma putrefaciens
ctggcggcatgcctaatacatgcaagtcgaacgggggtgcttgcaccccagtggcgaacgggtgagtaacacgtatctaacctaccttatagcgggggataacttttggaaacgaaagataataccgcatgtgaatcttattatcgcatgagaaaagattgaaagaaccgtttggttcactatgagatggggatgcggcgtattagctagtaggtgaggtaatggctcacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataaagtaggaaatgcctttatattgacggtaccttaccagaaagccacggctaactatgtgccagcagccgcggtaatacataggtggcaagcgttatccggatttattgggcgtatagggtgcgtaggcggttgtgcaagtttgaggttaaagtccggagctcaactccggttcgccttgaaaactgcattactagaatacaagagaggtaagcggaattccatgtgtagcggtgaaatgcgtagatatatggaagaacacctgtggcgaaagcggcttactggtttgttattgacgctgaggcacgaaagcgtggggagcaaataggattagataccctagtagtccacgccgtaaacgatgagtactaggtgttgggtgaactcagcgccgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtagaggttaacattgagacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggctggtacaaagagtcgcaatctcgcgagggggagctaatctcaaaaaaccagtctcagttcggattgaagtctgcaactcgacttcatgaagccggaatcactagtaatcgcgaatcagctatgtcgcggtgaatacgttctcgggtcttgtacacaccgcccgtcacaccacgagagttggtaataccagaagtgggtagcttaaccgcaaggagagcgcctcccaaggtaggactagcgattggggtgaagtcgtaacaaggtatccgtacgggaac

SEQ ID NO: 1324 - DNA, 1474 bp, Mycoplasma salivarium
  modified_base (152)..(152): a, c, t, g, unknown or other
  modified_base (188)..(188): a, c, t, g, unknown or other
  modified_base (329)..(330): a, c, t, g, unknown or other
  modified_base (486)..(486): a, c, t, g, unknown or other
  modified_base (541)..(541): a, c, t, g, unknown or other
  modified_base (553)..(554): a, c, t, g, unknown or other
  modified_base (760)..(760): a, c, t, g, unknown or other
  modified_base (890)..(891): a, c, t, g, unknown or other
  modified_base (896)..(952): a, c, t, g, unknown or other
  modified_base (1041)..(1041): a, c, t, g, unknown or other
  modified_base (1168)..(1168): a, c, t, g, unknown or other
  modified_base (1437)..(1437): a, c, t, g, unknown or other
  modified_base (1439)..(1439): a, c, t, g, unknown or other
  modified_base (1470)..(1470): a, c, t, g, unknown or other
aattttaagagtttgatcctggctcaggatgaacgctggctgtgtgcctaatacatgcatgtcgagcggaagtagcaatactttagcggcgaatgggtgagtaacacgtgcttaatctacctcttagattggaatacctaatggaaacattngttaatgccggatacgcatggagtcgcatgactccnttgtgaaaggggcctttaaagctccactaagagatgagggtgcggaacattagctagttggtgaggtaacggcccaccaaggctatgatgtttagccgggtcgagagactgaacggccacattgggactgagatacggccnnaactcctacgggaggcagcagtagggaatattccacaatgagcgaaagcttgatggagcgacacagcgtgcacgatgaaggtcttatggattgtaaagtgctgttgctagggaagaaaaagtagttgaggaaatgcttctacattgacggtacctngttagaaagcgatggctaactatgtgccagcagccgcggtaatacataggtcgcnagcgttatccgnnattattgggcgtaaagcgttcgtaggctgtttattaagtctggagtcaaatcccagggctcaaccctggctcgctttggatactggtaaactagagttggatagaggtaagcggaattccatgtgaagcggtgaaatgcgtagatatatggaagaacaccaaaggcgaaggcagcttactgggtttatactgacgctgaggaacgnaagcgtggggagcaaacaggattagataccctggtagtccacgccgtaaacgatgatcattagtcggcagagaactgttgacgcagctaacgcattaaatgatccgcctgagtagtatgctcgcaagagnnaaacnnnnnnnnnnnnnnnnnnnnnnnnnnnnnnnnnnnnnnnnnnnnnnnnnnnnnnnnntacgcggagaaccttacccactcttgacatccttcgcaaagctatagagatatagtggaggttaacggagtgacagatggtgcatggtngtcgtcagctcgtgtcgtgagatgtttggtcaagtcctgcaacgagcgcaacccctatctttagttactaacgagtcatgtcgaggactctagagatactgcctgggtaactgggaggaaggtgggnatgacgtcaaatcatcatgcctcttacgagtggggcaacacacgtgctacaatggtcggtacaaagagaagcaatatggcgacatggagcaaatctcaaaaagccgatctcagttcggattgaagtctgcaattcgacttcatgaagtcggaatcgctagtaatcgcagatcagctatgctgcggtgaatacgttctcgggtcttgtacacaccgcccgtcacaccatgggagctggtaatacccaaagtcggtttgctaaccgtccgngnaggcgactgcctaaggtaggactggtgactngggt

SEQ ID NO: 1325 - DNA, 1290 bp, Mycoplasmataceae genomosp. P1 oral clone MB1_G23
gattaacgctggcggtacgtctaatacatgcaagtcgaacgagtggcgaacgggtgagtaacacgtaggtaacctgcctacaagttggggataacacaaggaaacttgtgctaataccgaataattaaagctgcttgaagaggggcctgcggcgcattagttagttggtaaggtaatggcttaccaagacgatgatgcgtagctggactgagaggttgaacagccacattgggactgagaaacggcccagactcctacgggaggcagcagtagagaatcttcggcaatgggggaaaccctgaccgagcgataccgcgtgagtgatgaaatacttcggtatgtaaaattcttttattaaagaagatgacgttatttaatgaataagtcccggctaactatgtgccagcagccgcggtaatacataggggacgagcgttatccggaataattgggcgtaaagggtgcgtaggcggtgtgttaagttcaaggtttaatcgtagggctcaaccctatatcgctttgaaaactggcacactagagtaagatagaggcaagtggaattccatgtgtagcggtaaaatgcgtaaatatatggcagaacaccagaggcgaaggcggcttgctgggtctaccgacgctgaggcacgaaagcgtggggagcaaacaggattagataccctggtagtccacgccgtaaacgatgagcactaaaagtcgggttcggctttcaagttaacgcgataagtgctccgcctgagtagtacgtacgcaagtataaaactcaaaggaattggcgggacctcgcacaagcggtggatcatgttgtttaattcgttgatacgcgatgaaccttaccaggccttgacatatacaggtggtgcatggttgtcgtcagctcgtgtcgtgagatgttaggttaagtcctgcaacgagcgcaactcttattgctatttgccatcatgggcactatagtgagactgccagtgataaactggaggaaggtgggaatgacgtcaaatcatcatgccccttatggcctgggccacaaacgtgatacaatggttgtcaaaaggatgctagaaagtgattttaggcaaatccttacaatctcagttcggatgaagtctgcaactcgacttcagaagtcggaatcgctagtaatcgtagatcagaacgctacggtgaatacgttctcgaggtttgcacacaccgcccgtcaaaccacgaaagttaacaatacccaaaaccggtgcctaaggagccgtctaaggtagggttaatgattggggt

SEQ ID NO: 1326 - DNA, 1484 bp, Myroides odoratimimus
agcggcaggcctaacacatgcaagtcgaggggtagaaagagcttgcttttttgagaccggcgcacgggtgagtaacgcgtatgcaacctaccttatacaggggaatagcccgaagaaattcggattaatgctccatggtttatcgatatggcatcgtattgataataaagatttatcggtataagatgggcatgcgtatcattagctagttggtgtggtaacggcataccaaggcaacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaacctccctacgagtagggacttgacggtactgtaagaataaggatcggctaactccgtgccagcagccgcggtaatacggaggatccgagcgttatccggaattattgggtttaaagggttcgtaggcggctttgtaagtcagtggtgaaatttcctagcttaactaggacactgccattgatactgcagagcttgaataatatggaagtaactagaatatgtagtgtagcggtgaaatgcttagatattacatggaataccaattgcgaaggcaggttactacgtatttattgacgctgatgaacgaaagcgtggggagcgaacaggattagataccctggtagtccacgccgtaaacgatggatactagctgttcggttttcggactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacagatttggaaacagatttttcttcggacaatttacaaggtgctgcatggttgtcgtcagctcgtgccgtgaggtgtcaggttaagtcctataacgagcgcaacccctattgttagttaccagcgcgtagaggcggggactctagcaagactgccggtgcaaaccgtgaggaaggtggggatgacgtcaaatcatcacggcccttacgtcctgggctacacacgtgctacaatggcaagtacagaaagcagctacctggcaacaggatgcgaatctccaaagcttgtctcagttcggattggagtctgcaactcgactctatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactagtaactagggctaagtcgtaacaaggtagccgtaccggaaggtgcggctggatcacctcctttcta

SEQ ID NO: 1327 - DNA, 1481 bp, Myroides sp. MY15
agagtttgatcctggctcaggatgaacgctagcggcaggcctaacacatgcaagtcgaggggtatattgagcttgcttaatagagaccggcgcacgggtgagtaacgcgtatgcaacctaccttctacaggggaatagcccgaagaaattcggattaatgctccatggtttaattgaatggcatcatttaattaataaagatttatcggtagaagatgggcatgcgtatcattagctagttggtgtggtaacggcataccaaggcgacgatgattaggggtcctgagagggagatcccccacactggtactgagacacggaccagactcctacgggaggcagcagtgaggaatattggtcaatggaggcaactctgaaccagccatgccgcgtgcaggatgacggtcctatggattgtaaactgcttttgtacaggaagaaacctcgctacgagtagcgatttgacggtactgtaagaataaggatcggctaactccgtgccagcagccgcggtaatacggaggatccgagcgttatccggaattattgggtttaaagggttcgtaggcggttggataagtcagtggtgaaatttcttagcttaactaagacccggccattgatactgtttgacttgaatagtatggaagtaactagaatatgtagtgtagcggtgaaatgcttagatattacatggaataccaattgcgaaggcagggttactacgtacttattgacgctgatgaacgaaagcgtggggagcgaacaggattagataccctggtagtccacgccgtaaacgatggatactagctgttcggttttcggactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacaggtttggaaacagacttttcttcggacaatttacaaggtgctgcatggttgtcgtcagctcgtgccgtgaggtgtcaggttaagtcctataacgagcgcaacccctattgttagttaccatcgagtaatgtcgggaactctagcaagactgccggtgcaaaccgtgaggaaggtggggatgacgtcaaatcatcacggcccttacgtcctgggctacacacgtgctacaatggtcagtacagaaagcagctacctggcgacaggatgcgaatctcaaaagctgatcacagttcggattggagtctgcaactcgactccatgaagctggaatcgctagtaatcggatatcagccatgatccggtgaatacgttcccgggccttgtacacaccgcccgtcaagccatggaagctgggggtacctgaagtcggtgaccgcaaggagctgcctagggtaaaactagtaactagggctaagtcgtaacaaggtaacca

SEQ ID NO: 1328 - DNA, 1545 bp, Neisseria bacilliformis
ttgaacataagagtttgatcctggctcagattgaacgctggcggcatgctttacacatgcaagtcggacggcagcacagagaagcttgcttcttgggtggcgagtggcgaacgggtgagtaacgcatcggaacgtaccgagtaatgggggataactgtccgaaaggacagctaataccgcatacgccctgagggggaaagcgggggatcttaggacctcgcgttattcgagcggccgatgtctgattagctggttggcggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggggcatgttaataccgtgctctgatgacggtacctgaagaataagcaccggctaactacgtgccagcagccgcggtaatacgtagggtgcgagcgttaatcggaattactgggcgtaaagcgggcgcagacggttacttaagcgggatgtgaaatccccgggctcaacccgggaactgcgttccgaactgggtggctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttggggcacttgatgccttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaagggggccgcttgccacggtatgcttcatgactggggtgaagtcgtaacaaggtagccgtaggggaacctgcggctggatcacctcctttct

SEQ ID NO: 1329 - DNA, 1549 bp, Neisseria cinerea
tgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagggaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgttcagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccgcaaggggtccgcttaccacggtatgcttcatgactggggtgaagtcgtaacaaggtagccgtaggggaacctgcggctggatcacctcctttctagaga

SEQ ID NO: 1330 - DNA, 1544 bp, Neisseria elongata
ttgaacataagagtttgatcctggctcagattgaacgctggcggcatgctttacacatgcaagtcggacggcagcggggtagtgcttgcactactgccggcgagtggcgaacgggtgagtaatatattggaacgtaccgagtaatgggggataaccaatcgaaagattggctaataccgcatacgctctgaggaggaaagcaggggaccttcgggccttgcgttattcgagcggccaatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaaaggaacggttaatacccgtttctgctgacggtacctaaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtagctagagtatgtcagaggggggtagaattccacgtgtagcagtgaaatgcgtagagatgtggaggaataccgatggcgaaggcagccccctgggataatactgacgttcatgctcgaaagcgtgggtagcaaacaggattagataccctggtagtccacgccctaaacgatgtcgattagctgttgggcagcttgactgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacaaagggtagccaagccgcgaggcggagccaatctcataaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgtaaggagcccgcttaccacggtatgcttcatgactggggtgaagtcgtaacaaggtagccgtaggggaacctgcggctggatcacctcctttct

SEQ ID NO: 1331 - DNA, 1549 bp, Neisseria flavescens
tgaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtaatgggggataactaatcgaaagattagctaataccgcatattctctgaggaggaaagcaggggaccttcgggccttgcgttattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcgacagctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1332 - DNA, 1278 bp, Neisseria genomosp. P2 oral clone MB5_P15
attgaacgctggcggcatgctttacacatgcaagtcgaacgagtggcgaacgggtgagtaacatattggaacgtaccgagtagtgggggataactaatcgaaagattagctaataccgcatacggaaagacgctatttgagcggccaatatcggattagctagttggtggggtaaaggcctaccaaggcgacgatccgtagcgggtctgagaggacgatccgccgcattgggactgagacacggcccaaactcctacgggaggcagcagtggggaattttggacaatgggggcaaccctgatccagccatgccgcgtgtctgaagaaggccttcgggttgtaaaggacttttgctagggaagatgacggtacctaaagaataagcaccggctaactacgtgccagcagccgcggtaatacgtagggtgcgagcgttaatcggaattactgggcgtaaagcgagcgcagacggtttgtcaagcaggatgtgaaatccccgagctcaacttgggaactgcgttctgaactggcaggctagagtatgtcagaggggggtagaattccacgtgtagcagtgaaatgcgtagagatgtggaggaataccgatggcgaaggcagccccctggggtaactgacgttcatgctcgaaagcgtgggtagcaaacaggattagataccctggtagtccacgccctaaacgatgtcaattagctgttgggcgcttagtagcgaagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggttggcagagggtagccaaatcgcgagatggagccaatcccagccaatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatg

SEQ ID NO: 1333 - DNA, 1553 bp, Neisseria gonorrhoeae
gattgaacataagagtttgatcctggctcagattgaacgctggcggcatgctttacacatgcaagtcggacggcagcacagggaagcttgcttctcgggtggcgagtggcgaacgggtgagtaacatatcggaacgtaccgggtagcgggggataactgatcgaaagatcagctaataccgcatacgtcttgagagggaaagcaggggaccttcgggccttgcgctatccgagcggccgatatctgattagctggttggcggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggccgttgccaatatcggcggccgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtggaattccacgtgtagcagtgaaatgcgtagagatgtggaggaataccgatggcgaaggcagcctcctgggataacactgacgttcatgtccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggttttgacatgtgcggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcggttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagagaa

SEQ ID NO: 1334 - DNA, 1549 bp, Neisseria lactamica
tgaacataagagtttgatcctggctcagattgaacgctggcggcatgctttacacatgcaagtcggacggcagcggggtagtgcttgcactactgccggcgagtggcgaacgggtgagtaacatatcggaacgtaccgggcagtgggggataactgatcgaaagatcagctaataccgcatattttctgaggaagaaagcaggggaccttcgggccttgcgctatccgagcggccgatatctgattagctggttggcggggtaaaggcccaccaaggcgacgatcagtagcgggtctgagaggacgatccgccacactgggactgagacacggcccagactcctacgggaggcagcagtggggaattttggacaatgggcgcaagcctgatccagccatgccgcgtgtctgaagaaggccttcgggttgtaaaggacttttgtcggggaagaaaaggtcggggttaataccctcggctgatgacggtacccgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaattgcgttctgaactgggtggctagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcctgactgcttggtagcgaagctaacgcgtgaaatcgaccgcctggggagtacggtcgcaagattaaaactcaaaggaattgacggggacccgcacaagcggtggatgatgtggattaattcgatgcaacgcgaagaaccttacccggttttgacatgtacggaatcctccggagacgggggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccggggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaaggaggccgcttgccacggtatgcttcatgactggggtgaagtcgtaacaaggtagccgtaggggaacctgcggctggatcacctcctttctagaga

SEQ ID NO: 1335 - DNA, 1529 bp, Neisseria macacae
agagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacct

SEQ ID NO: 1336 - DNA, 1549 bp, Neisseria meningitidis
tgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagaga

SEQ ID NO: 1337 - DNA, 1547 bp, Neisseria mucosa
aacataagagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggatagggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1338 - DNA, 1352 bp, Neisseria pharyngis
cacagagaagcttgcttcttgggtggcgagtggcgaacgggtgagtaacatatcggaacgtaccgagcagtgggggataactaatcgaaagattagctaataccgcatatattctgaggaagaaagcaggggaccatttggccttgcgctgtttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggacagggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtggggg

SEQ ID NO: 1339 - DNA, 1545 bp, Neisseria polysaccharea
ttgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagtagtgggggataactgatcgaaagatcagctaataccgcatacgtcttgagagggaaagcaggggaccttcggaccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcaattagctgttgggcaacttgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtgggtaggataaccgcaaggggtccgcttaccacggtatgcttcatgactggggtgaagtcgtaacaaggtagccgtaggggaacctgcggctggatcacctcctttct

SEQ ID NO: 1340 - DNA, 1549 bp, Neisseria sicca
tgaacataagagtttgatcctggctcagattgaacgctggcggcatgctttacacatgcaagtcggacggcagcacagagaagcttgcttcttgggtggcgagtggcgaacgggtgagtaacatatcggaacgtaccgagcagtgggggataactaatcgaaagattagctaataccgcatatcttctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacttgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1341 - DNA, 1254 bp, Neisseria sp. KEM232
ctttacacatgcaagtcggacgagtggcgaacgggtgagtaatgtattggaacgtaccgagtaatgggggataaccaatcgaaagattggctaataccgcatacggaaaggcgttattcgagcggccaatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagatgacggtacctgaagaataagcaccggctaactacgtgccagcagccgcggtaatacgtagggtgcgagcgttaatcggaattactgggcgtaaagcgggcgcagacggtttgttaagcaggatgtgaaatccccgggctcaacccgggaactgcgttctgaactggcaggctagagtgtgtcagaggggggtagaattccacgtgtagcagtgaaatgcgtagagatgtggaggaataccgatggcgaaggcagccccctgggataactgacgttcatgcccgaaagcgtgggtagcaaacaggattagataccctggtagtccacgccctaaacgatgtcgattagctgttgggcgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtagccaagccgcgaggcggagccaatcccagccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagcaggtggctaggccgcttgccacg

SEQ ID NO: 1342 - DNA, 1406 bp, Neisseria sp. SMC-A9199
gcaagtcggacggcagcgaggaagtgcttgcacttctgtcggcgagtggcgaacgggtgagtaacatatcggaacgtaccgagtagtgggggataactaatcgaaagattagctaataccgcatacgtcttgagagagaaagcaggggaccttcgggccttgcgctattcgagcggccgatatctgattagctagttggtggggtaaaggcccaccaaggcgacgatcagtagcgggtctgagaggatgatccgccacactgggactgagacacggcccagactcctacgggaggcagcagtggggaattttggacaatgggcgcaagcctgatccagccatgccgcgtgtatgaagaaggccttcgggttgtaaagtacttttgtcagggaagaaaaggccggtgttaataccattggctcatgacggtacctgaagaataagcaccggctaactacgtgccagcagccgcggtaatacgtagggtgcgagcgttaatcggaattactgggcgtaaagcgagcgcagacggtttgttaagcaggatgtgaaatccccgggctcaacctgggaactgcgttctgaactggcaagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccttcgggagtccgct

SEQ ID NO: 1343 - DNA, 1363 bp, Neisseria sp. TM10_1
  modified_base (1352)..(1352): a, c, t, g, unknown or other
cacagagaagcttgcttcttgggtggcgagtggcgaacgggtgagtaacatatcggaacgtaccgagcagtgggggataactaatcgaaagattagctaataccgcatatcttctgaggaagaaagcaggggaccatttggccttgcgctgtttgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaagggcggggttaatacccctgtctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgcccgaaagcgtgggtagcaaacaggattagataccctggtagtccacgccctaaacgatgtcgattagctgttgggcagcatgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtggggngatacagaagt

SEQ ID NO: 1344 - DNA, 1499 bp, Neisseria sp. oral clone AP132
agagtttgatatggctcagattgaacgctggcggcatgctttacacatgcaagtcggacggcagcggggagtgcttgcactctgccggcgagtggcgaacgggtgagtaatgcatcggaacgtaccgagtaatgggggataactgtccgaaaggacagctaataccgcatacgccctgagggggaaagcgggggatcttaggacctcgcgttattcgagcggccgatgtctgattagctagttggtggggtaaaggcctaccaaggcgacgatcagtagcgggtctgagaggacgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcgggtgctaataccatctgctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacgctgacgttcatgcccgaaagcgtgggtagcaaacaagattagataccctggtagtccacgccctaaacgatgtcgattagctgctgggcagcttgactgcttagtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccctccagagacggaggggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcgtgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaagggtarc

SEQ ID NO: 1345 - DNA, 1363 bp, Neisseria sp. oral clone JC012
gagtttgattctggctcagattgaacgcgggcgccatgctttacacatgcaagtcgaacgagtggcgaacgggtgagtaacatattggaacgtaccgagtaaagggggataactatccgaaaggatagctaataccgcatacggaaagacgttattcgagcggccaatatctgattagctagttggtggggtaaaggcctaccaaggcgacgatcagtagcgggtctgagaggacgatccgccacactgggactgagacacggcccagactcctacgggaggcagcagtggggaattttggacaatgggcgcaagcctgatccagccatgccgtgtgtctgaagaaggccttcgggttgtaaaggacttttgttagggaagatgacggtacctaaagaataagcaccggctaactacgtgccagcagccgcggtaatacgtagggtgcgagcgttaatcggaattactgggcgtaaagcgagcgcagacggtttgttaagcaggatgtgaaatccccaggctcaacttgggaactgcgttctgaactggcaagctagagtgtgtcagaggggggtagaattccacgtgtagcagtgaaatgcgtagagatgtggaggaataccgatggcgaaggcagccccctgggataactgacgttcatgctcgaaagcgtgggtagcaaacaggattagataccctggtagtccacgccctaaacgatgtcaattagctgttgggcgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgcacaggtgctgcatggctgtcgtcagctcgtgtcgtgagatgttgggttaagtcccgcaacgagcgcaacccttgtcattagttgccatcatgggcactctaatgagactgccggtgacaaaccggaggaaggtggggatgacgtcaagtcctcatggcccttatgaccagggcttcacacgtcatacaatggtcggcagagggtcgccaagccgcgaggtggagccaatctcacccgatcgtagtccggatgcactctgcaactcgagtgcagaagtcggaatcgctagtaatcgcaggtcagcatactgcggtgaatacgttcccgggtcttgtacacaccgcccgtcacaccatgggagtgggggataccagaagtaggtggctaggccgcttaccacggtatgtttcatgactggggtgaagtcgtaacaaggtagccgtaggggaacctgcggctggaacacctcctt

SEQ ID NO: 1346 - DNA, 1473 bp, Neisseria sp. oral strain B33KA
gattgaacgctggcggcatgctttacacatgcaagtcggacggcagcacagagaagcttgcttcttgggtggcgagtggcgaacgggtgagtaatgtattggaacgtaccgagtaatgggggataaccaatcgaaagattggctaataccgcatacgtcctgagggggaaagcgggggatcttcggacctcgcgttattcgagcggccaatatctgattagctggttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggcttttgataataccaggagctgatgacggtacctgaagaataagcaccggctaactacgtgccagcagccgcggtaatacgtagggtgcgagcgttaatcggaattactgggcgtaaagcgggcgcagacggtttgttaagcaggatgtgaaatccccgggctcaacccgggaactgcgttctgaactggcaggctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttgggcagcttgactgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaaggaggccgcttgccacggtatgcttcatgactggggtgaagtcgtaa

SEQ ID NO: 1347 - DNA, 1545 bp, Neisseria sp. oral taxon 014
ttgaacataagagtttgatcctggctcagattgaacgctggcggcatgctttacacatgcaagtcggacggcagcggggtagtgcttgcactactgccggcgagtggcgaacgggtgagtaacatatcggaacgtaccgagcagtgggggataactaatcgaaagattagctaataccgcatatattctgaggaagaaagcaggggacctttgggccttgcgctgtttgagcggccgatatctgattagctggttggtggggtaaaggcctaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtccgggaagaaaagcgcgatgttaataccattgcgtgctgacggtaccggaagaataagcaccggctaactacgtgccagcagccgcggtaatacgtagggtgcgagcgttaatcggaattactgggcgtaaagcgggcgcagacggttacttaagcaggatgtgaaatccccgggctcaacctgggaattgcgttctgaactgggtggctagagtgtgtcagaggggggtagaattccacgtgtagcagtgaaatgcgtagagatgtggaggaataccgatggcgaaggcagccccctgggatagcactgacgttcatgcccgaaagcgtgggtagcaaacaggattagataccctggtagtccacgccctaaacgatgtcgattagctgttgggcaacttgattgcttggtagcgaagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccggagacggaagggtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatcccaaaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaagggggccgcttgccacggtatgcttcatgactggggtgaagtcgtaacaaggtagccgtaggggaacctgcggctggatcacctcctttct

SEQ ID NO: 1348 - DNA, 1549 bp, Neisseria subflava
tgaacataagagtttgatcctggctcagattgaacgctggcggcatgctttacacatgcaagtcggacggcagcacagagaagcttgcttcttgggtggcgagtggcgaacgggtgagtaatatatcggaacgtaccgagtaatgggggataactaatcgaaagattagctaataccgcatattctctgaggaggaaagcaggggaccttcgggccttgcgttattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaataccgacagctgatgacggtacctgaagaataagcaccggctaactacgtgccagcagccgcggtaatacgtagggtgcgagcgttaatcggaattactgggcgtaaagcgagcgcagacggttacttaagcaggatgtgaaatccccgggctcaacctgggaactgcgttctgaactgggtgactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccagagacggaggagtgccttcgggaaccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagggtaaccgcaaggagcccgcttaccacggtatgcttcatgactggggtgaagtcgtaacaaggtagccgtaggggaacctgcggctggatcacctcctttctagaga

SEQ ID NO: 1349 - DNA, 1495 bp, Neorickettsia risticii
atttgagagtttgatcctggctcagaacgaacgctagcggtaggcttaacacatgcaagtcgaacggaatcagggctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagataatgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaagaactgcatttaaaactgtgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggattgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgagctagctacaccgtaaggtgacgccaatctcttaaaggttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctccttt

SEQ ID NO: 1350 - DNA, 1495 bp, Neorickettsia sennetsu
atttgagagtttgatcctggctcagaacgaacgctagcggtaggcttaacacatgcaagtcgaacggaatcaaagctgcttgcagccttggtcccgtggcagacgggtgcgtaacgcgtgggaacttgcctggtagtagggaataaccagtggaaacattgggcaacaccctatacgccctgagggggaaaatttattgctatcagataggcccgcgttagattagctagttggtggggtaatggcctaccaaggcgacgatctatagctggtctgagaggatgatcagccacactggaactgagacacggtccagactcctacgggaggcagcagtgaggaatattggacaatgggcgaaagcctgatccagccataccgcatgagtgatgaaggcccttgggttgtaaagctcttttagtggggaagatagtgacggtacccacagaagaagtcccggctaactccgtgccagcagccgcggtaatacggagggggctagcgttgttcggaattactgggcgtaaagggtgcgtaggcggtcccgtaagttaggtgtgaaatccttgggcttaacccaggaactgcatttaaaactgcgggactcgaacgtgagagagggcaatggaatttttggtgtaggggtgaaatccgtagatatcaagaggaacgtcaggggcgaaagcgattgcctggatcacagttgacgctgaggcacgaaagcgtggggagcaaacaggattagataccctggtagtccacgctgtaaacgatgagtgttaaaagtgggttattttatctgctttgtagctaacgcgttaaacactccgcctggggactacggtcgcaagactaaaactcaaaggaattgacggggactcgcacaagcggtggagtatgtggtttaattcgatgcaacgcgaaaaaccttaccataccttgacatgtggatcgtatccctctgaagggagggagtcagttcggctggatccaacacaggtgttgcatggctgtcgtcagctcgtgtcgtgagatgttgggttaagtcccgcaacgagcgcaaccctcatccttagttgccagcggttcggccgggaactttaaggaaactgccagtgacaagctggaggaaggtggggacgacgtcaagtcatcatggcccttatggtatgggctacacacgtactacaatggcaactacaatgggctagctacaccgtaaggtgatgcaaatctcctaaaagttgtctcagtacggattgccttctgcaactcgaaggcatgaagttggaatcgctagtaatcgcagatcagcatgctgcggtgaatacgttctcgggtcttgtacacactgcccgtcaggccatgggagttcatcttactcgaagctagtgagctgaccgcaaggaggcagctatctacggtggggtgggtgactggggttaagtcgtaacaaggtagccgtaggtgaacctgcggctggattacctccttt

SEQ ID NO: 1351 - DNA, 1530 bp, Nocardia brasiliensis
tcttcaacggagagtttgatcctggctcaggacgaacgctggcggcgtgcttaacacatgcaagtcgagcggtaaggcccttcggggtacacgagcggcgaacgggtgagtaacacgtgggtgatctgcctcgcacttcgggataagcctgggaaactgggtctaataccggatatgacctttcagtgcatgctgttgggtggaaagatttatcggtgcgagatgggcccgcggcctatcagcttgttggcggggtaacggcccaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggtttgtcgcgtcgtccgtgaaaacttggggctcaaccccaagcttgcgggcgatacgggcagacttgagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttgtcctgtgttgccagcggattatgccggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggattggcgattgggacgaagtcgtaacaaggtagccgtaccggaaggtgcggctggatcacctcctttctaaggag

SEQ ID NO: 1352 - DNA, 1434 bp, Nocardia cyriacigeorgica
ttaacacatgcaagtcgagcggtaaggcccttcggggtacacgagcggcgaacgggtgagtaacacgtgggtgatctgcctcgcactctgggataagcctgggaaactgggtctaataccggatatgaccttacatcgcatggtgtttggtggaaagatttatcggtgcgagatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggcttgtcgcgtcgatcgtgaaaacttggggctcaaccccaagcttgcggtcgatacgggcaggcttgagtacttcaggggagactggaattcctggtgtagcggtgaaatgcgcagatatcaggaggaacaccggtggcgaaggcgggtctctgggaagtaactgacgctgagaagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaag

SEQ ID NO: 1353 - DNA, 1522 bp, Nocardia farcinica
cttcaacggagagtttgatcctggctcaggacgaacgctggcggcgtgcttaacacatgcaagtcgagcggtaaggcccttcggggtacacgagcggcgaacgggtgagtaacacgtgggtgatctgccctgtacttcgggataagcctgggaaactgggtctaataccggatatgaccttacatcgcatggtgtttggtggaaagatttatcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcgacagggacgaagcgcaagtgacggtacctgtagaagaagcaccggccaactacgtgccagcagccgcggtaatacgtagggtgcgagcgttgtccggaattactgggcgtaaagagcttgtaggcggtttgtcgcgtcgtccgtgaaaacttggggctcaactccaagcttgcgggcgatacgggcagacttgagtactgcaggggagactggaattcctggtgtagcggtgaaatgcgcagatatcaggaggaacaccggtggcgaaggcgggtctctgggcagtaactgacgctgagaagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaaccttgtcctgtgttgccagcgcgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttct

SEQ ID NO: 1354 - DNA, 1328 bp, Nocardia puris
aacacatgcaagtcgagcgagcggcgaacgggtgagtaacacgtgggtgatctgccctgcactctgggataagcctgggaaactgggtctaataccggatatggaaagtcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcgacagggacgatgacggtacctgtagaagaagcaccggccaactacgtgccagcagccgcggtaatacgtagggtgcgagcgttgtccggaattactgggcgtaaagagcttgtaggcggcttgtcgcgtcgatcgtgaaaacttggggctcaaccccaagcttgcggtcgatacgggcaggcttgagtactgcaggggagactggaattcctggtgtagcggtgaaatgcgcagatatcaggaggaacaccggtggcgaaggcgggtctctgggcagactgacgctgagaagcgaaagcgtgggtagcgaacaggattagataccctggtagtccacgccgtaaacggtgggcgctaggtgtgggttgatccgtgccgtagctaacgcattaagcgccccgcctggggagtacggccgcaggctaaaactcaaaggaattgacgggggcccgcacaagcggcggagcatgtggattaattcgatgcaacgcgaagaaccttacctgggtttgacatatacaggtggtgcatggctgtcgtcagctcgtgtcgtgagatgttgggttaagtcccgcaacgagcgcaacccttgtcctgtgttgccagcaattggggactcgcaggagactgccggggtcaactcggaggaaggtggggacgacgtcaagtcatcatgccccttatgtccagggcttcacacatgctacaatggccggcagagggctgcgataccgtgaggtggagcgaatcccttccggtctcagttcggacggggtctgcaactcgaccccggaagttggagtcgctagtaatcgcagatcagcaacgctgcggtgaatacgttcccgggccttgtacacaccgcccgtcacgtcatgaaagtcggtaacacccgaagccggtgcccagggagccgtcgaaggtgggatcggcgattgggacgaagtcgtaacaaggtagccgtaccggaaggtgcggctggatcacctcctttct

SEQ ID NO: 1355 - DNA, 1375 bp, Nocardia sp. 01-Je-025
cggtaaggcccttcggggtacacgagcggcgaacgggtgagtaacacgtgggtgatctgcctcgcacttcgggataagcctgggaaactgggtctaataccggatatgaccgactagtgcatgctggttggtggaaagatttatcggtgcgagatgggcccgcggcctatcagcttgttggtgaggtaacggctcaccaaggcgacgacgggtagccgacctgagagggtgaccggccacactgggactgagacacggcccagactcctacgggaggcagcagtggggaatattgcacaatgggcgaaagcctgatgcagcgacgccgcgtggaggatgacggccttcgggttgtaaactcctttcgacagggacgaagcgaaagtgacggtacctgtagaagaagcaccgggccaactacgtgccagcagccgcggtaatacgtagggtgcgagcgttgtccggaattactgggcgtaaagagcttgtaggcggtctgtcgcgtcttctgtgaaaacttggggctcaaccttaagcttgcaggcgatacgggcagactagagtacttcaggggagactggaattcctggtgtagcggtgaaatgcgcagatatcaggaggaacaccggtggcgaaggcgggtctctgggaagtaactgacgctgagaagcgaaagcatgggtagcaaacaggattagataccctggtagtccatgccgtaaacggtgggtactaggtgtgggtttccttccacgggatccgtgccgyagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccggaaacctgcagagatgtaggcccccttgtggtcggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccagtacagagggctgcgagaccgcgaggtggagcgaatcccttaaagctggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagcc

SEQ ID NO: 1356 - DNA, 1528 bp, Nocardiopsis dassonvillei
tttatggagagtttgatcctggctcaggacgaacgctggcggcgtgcttaacacatgcaagtcgagcggtaaggcccttcggggtacacgagcggcgaacgggtgagtaacacgtgagcaacctgcccctgactctgggataagcggtggaaacgccgtctaataccggatacgacccgccacctcatggtggagggtggaaagtttttcggtcagggatgggctcgcggcctatcagcttgttggtggggtaacggcctaccaaggcgattacgggtagccggcctgagagggcgaccggccacactgggactgagacacggcccagactcctgcgggaggcagcagtggggaatattgcgcaatgggcgaaagcctgacgcagcgacgccgcgtgggggatgacggccttcgggttgtaaacctcttttaccaccaacgcaggcttccagttctctggaggttgacggtaggtggggaataaggaccggctaactacgtgccagcagccgcggtaatacgtagggtccgagcgttgtccggaattattgggcgtaaagagctcgtaggcggcgtgtcgcgtctgctgtgaaagaccggggcttaactccggttctgcagtggatacgggcatgctagaggtaggtaggggagactggaattcctggtgtagcggtgaaatgcgcagatatcaggaggaacaccggtggcgaaggcgggtctctgggccttacctgacgctgaggagcgaaagcatggggagcgaacaggattagataccctggtagtccatgccgtaaacgttgggcgctaggtgtggggactttccacggtttccgcgccgtagctaacgcattaagcgccccgcctggggagtacggccgcaggctaaaactcaaggaattgacgggggcccgcacaagcggcggagcattgttgcttaattcgacgcagcgcgaagaaccttaccaaggtttgacatcacccgtggactcgcagagatgtgaggtcatttagttggcgggtgacaggtggggcatggctgtcgtcagctcgtgtcgtgagatgttgggttagtcccgcaacgagcgcaatccttgttcatgttgtcagcatgtatggtggggactcttgggagactggccggggtcaactcggagaagggtggggatgacgtcagtctcatgccccttatgtctgggctgcaaacatgctacaatggccggtacaatgggcgtgcgatacgtaaggtggagcgaatccctaaaagccggtctcagttcggattggggtctgcaactcgaccccatgaaggtggagtcgctagtaatcgcggatcagcaacgccgcggtgaatacgttcccgggccttgtacacaccgcccgtcacgtcatgaaagtcggcaacacccgaaacttgcggcctaaccccttgtgggagggagtgagtgaaggtggggctggcgattgggacgaagtcgtaacaaggtagccgtaccggaaggtgcggctggatcacctcctttct

SEQ ID NO: 1357 - DNA, 1486 bp, Novosphingobium aromaticivorans
aacttgagagtttgatcctggctcagaacgaacgctggcggcatgcctaacacatgcaagtcgaacgaacccttcggggttagtggcgcacgggtgcgtaacgcgtgggaatctgccctttgcttcggaataacagttagaaatgactgctaataccggatgatgtcttcggaccaaagatttatcggcaagggatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggtcacttggtgattgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgcgctacttccagagatggaaggttcccttcggggacgcggtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttct

SEQ ID NO: 1358 - DNA, 1529 bp, Oceanobacillus caeni
agagtttgatcctggctcaggacgaacgctggcggcgtgcctaatacatgcaagtcgagcgctggaagctaatttcatcccttcgggatgaaattagtggaaagagcggcggacgggtgagtaacacgtgggcaacctacctataagactgggataactcgcggaaacgtgagctaataccggataatactttttattgcataataaggagtttgaaaggcggcgtaagctgtcacttatagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggaacaacgccgcgtgagtgaagaaggttttcggatcgtaaaactctgttgttagggaagaacaagtcaggtagtaactgacctgaccttgacggtacctaaccagaaagccacggctaactacgtgccagcagccgcggtaatacgtaggtggcaagcgttgtccggatttattgggcgtaaagcgctcgcaggcggtcttttaagtctgatgtgaaagcccacggcttaaccgtggagggtcattggaaactggaggacttgagtgcagaagaggagagtggaattccatgtgtagcggtgaaatgcgtagagatatggaggaacaccagtggcgaaggcgactctctggtctgtaactgacgctgaggagcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctttcgacctccctagagatagggatttcccttcggggacgaaagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcgaaaccgcaaggtcaagcaaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtaaccca

SEQ ID NO: 1359 - DNA, 1347 bp, Oceanobacillus sp. Ndiop
tcctggcaagaagatgaaaggcggcttttagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacaagtgcgagagtaactgctcgcaccttgacggtacctgaccagaaagccacggctaactacgtgccagcagccgcggtaatacgtaggtggcaagcgttgtccggaattattgggcgtaaagcgctcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccaccctagagatagggatttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggaagcgaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggactaatgattggggtgaagtcgtaacaaggtagccgtatcggaaggtgcggctg

SEQ ID NO: 1360 - DNA, 1487 bp, Ochrobactrum anthropi
ttcaacttgagagtttgatcctggctcagaacgaacgctggcggcaggcttaacacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttct

SEQ ID NO: 1361 - DNA, 1493 bp, Ochrobactrum intermedium
aacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgagcccgaaaggggaaagatttatcggcaaatgatcggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 1362 - DNA, 1396 bp, Ochrobactrum pseudintermedium
gagagtttgatcctggctcagaacgaacgctggcggcaggcttaacacatgcaagtcgagcgcgtagcaatacgagcggcagacgggtgagtaacgcgtgggaatctacccatcactagggaataactcagggaaacttgtgctaataccctatacgaccgagaggtgaaagatttatcggtgatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcgggctaataagtcaggggtgaaatcccggggctcaaccccggaactgcctttgatactgttagtcttgagtatggaagaggtgagtggaattccgagtgtagaggtgaaatttgtagatattcggaggaacaccagtggcgaaggcggctcactggtccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaatttgaagcaacgcgcagaaccttaccagcccttgacatcccgatcgcggttagtggagacactttccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggc

SEQ ID NO: 1363 - DNA, 1317 bp, Odoribacter laneus
gatgaacgctagcgacaggcttaacacatgcaagtcgagggaccggcgcacgggtgagtaacgcgtatgcaacctgcctttgacagagggatagcccatggaaacgtggattaatacctcatagttaaaagtggtcaaagatgggcatgcgtcctattaggcagttggcggggtaacggcccaccaaaccgatgataggtaggggttctgagaggaaggtcccccacactggtactgagacacggaccagactcctacgggaggcagcagtgaggaatattggtcaatggtcgagagactgaaccagccaagtcgcgtgagggatgactgcctatgggttgtaaacctcttttctactgggagatgacagtacagtaggaataagcatcggctaactccgtgccagcagccgcggtaatacggaggatgcgagcgttatccggatttattgggtttaaagggtgcgtaggcggctttataagttagtggtaaaatttcggagcttcactccggtccgccattaaaactgtagagctagagaatggacgaggtaggcggaataagttaagtagcggtgaaatgcatagatataacttagaactccgatagcgaaggcagcttaccagaccaactgacgctgatgcacgagagcgtgggtagcgaacaggattagataccctggtagtccacgccgtaaacgatgctcaccggcccttagcgagttaggggttaattgaaagaattaagtgagccacctggggagtacgtcggcaacgatgaaactcaaaggaattgacgggggcccgcacaagcggaggaacatgtggtttaattcgatgatacgcgaggaaccttacctgggtttaaatgtacaaggtgctgcatggttgtcgtcagctcgtgccgtgaggtgtcgggttaagtcccataacgagcgcaacccttaccgttagttgctaacatatgagcactctagcgggactgccaccgtaaggtggaggaagggggggatgacgtcaaatcagcacggcccttacatccagggcgacacacgtgttacaatggccatcagcgggtagctaccgggtgaccggatgcaaatctcgatggtctaagttcggatggagtctgcaacccgactccagaagttggattcgctagtaatcgcgcatcagccatggcgcggtgaatacgttcccgggccttgtacacaccgcccgtcaagccatggaagctgggagtacctgaagtccgtatcggcctagggtaataccggtaactggggctaagtcgwaacaaggtagccgtaccggaagg

SEQ ID NO: 1364 - DNA, 1368 bp, Odoribacter splanchnicus
tcgaggggcagcatgaggtagcaataccttgatggcgaccggcgcacgggtgagtaacgcgtatgcaacctgcctgataccggggtatagcccatggaaacgtggattaacaccccatagtacttttatcctgcctgggatgggagttaaatgtttaaggtatcggatgggcatgcgtcctattagttagttggcggggtaacagcccaccaagacgatgataggtaggggttctgagaggaaggtcccccacattggaactgagacacggtccaaactcctacgggaggcagcagtgaggaatattggtcaatggacgtaagtctgaaccagccaagtcgcgtgagggaagactgccctatgggttgtaaacctcttttataagggaagaataagttctactgtaatgatgcctgtactgataagcatcggctatctgccagcagccgcggtaatacggaggatgcgagcgttatccggatttattgggtttaaagggtgcgtaggcggtttattaagttagtggttaaatatttgagctaaactcaattgtgccattaatactggtaaactggagtacagacgaggtaggcggaataagttaagtagcggtgaaatgcatagatataacttaaactccgatagcgaaggcagcttaccagactgtaactgacgtgatgcacgagagcgtgggtagcgaacaggattagataccctggtagtccacgccgtaaacgatgctcactggttctgtgcgatatattgtacgggattaagcgaaagtattaagtgagccacctggggagtacgtcggcaacgatgaaactcaaaggaattgacgggggcccgcacaagcggaggaacatgtggtttaattcgatgatacgcgaggaaccttacctgggtttaaatgggaaatgccgtatttggaaacagatattctcttcggagcgtttttcaaggtgctgcatggttgtcgtcagctcgtgccgtgaggtgtcgggttaagtcccataacgagcgcaacccttaccgttagttgctagcatgtaatgatgagcactctaacgggactgccaccgtaaggtgagaggaaggcggggatgacgtcaaatcagcacggcccttacacccagggctacacacgtgttacaatggccggtacagagggccgctaccaggtgactggatgccaatctcaaaagccggtcgtagttcggattggagtctgtaacccgactccatgaagttggattcgctagtaatcgcgcatcagccatggcgcggtgaatacgttcccgggccttgtacacaccgcccgtcaagccatggaagccgggggtgcctgaagtccgtaaccgcgaggat

SEQ ID NO: 1365 - DNA, 1398 bp, Okadaella gastrococcus
tgaagcttggtgcttgcaccgagcggatgagttgcgaacgggtgagtaacgcgtaggtaacctgcctcttagcgggggataactattggaaacgatagctaataccgcataaaagacgatatcgcatgatattgatttgaaaggtgcaattgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggaacatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccag

SEQ ID NO: 1366 - DNA, 1489 bp, Oligella ureolytica
attgaacgctagcgggatgctttacacatgcaagtcgaacggcagcacagaggaacttgttccttgggtggcgagtggcggacgggtgagtaatgtatcggaacgtgcccagtagtgggggataactacgcgaaagcgtggctaataccgcatattctctacggaggaaagggggggatcatttgacctctcgctattggagcggccgatattagattagctagttggtggggtaacggcctaccaaggcagtgatctatagctggtttgagaggacgaccagccacactgggactgagacacggcccagactcctacgggaggcagcagtggggaattttcgacaatggggggaaccctgatcgagccatcccgcgtgtgggacgaaggccttcgggttgtaaaccacttttctcaacgaagaaaagtcttaggctaataccttaagatgctgacggtagttgaggaataagcaccggctaactatgtgccagcagccgcggtaatacatagggtgcaagcgttaatcggaattactgggcgtaaagggtgcgcaggcggcttggaaagaacggtgtgaaatcccggggctcaacctcggaactgcactattaactatcaagctagagtatgtcagaggggggtggaattccgcgtgtagcagtgaaatgcgtagatatgcggaggaacaccaatggcgaaggcagccccctgggataatactgacgctcaggcacgaaagcgtgggtagcaaacaggattagataccctggtagtccacgccctaaacgatgtcaactagctgttgggccggttacggcttagtagcgcagctaacgcgtgaagttgaccgcctggggactacggtcgcaagactaaaactcaaaggaattgacggggacccgcacaagcggtggatgatgtggattaattcgatgcaacgcgaaaaaccttacctacccttgacatgcctggaagctttaagagattaaagtgtgctcgcaagagaaccggtgcacaggtgctgcatggctgtcgtcagctcgtgtcgtgagatgttgggttaagtcccgcaacgagcgcaacccttgtcattagttgctacgtaagagcactctagtgagactgccggtgacaaaccggaggaaggtggggatgacgtcaagtcctcatggcccttatgggtagggcttcacacgtcatacaatggtcgggacagagggttgccaagccgcgaggtggagctaatctcttaaacccgatcgtagtccggattgcaggctgcaactcgcctgcatgaagtcggaatcgctagtaatcgcagatcagaatgctgcggtgaatacgttcccgggtcttgtacacaccgcccgtcacaccatgggagtgggttttaccagaagtagttagtctaaccgcaagggggacgattaccacggtaggattcatgactggggtgaagtcgtaacaaggtagccgtaccggaagg

SEQ ID NO: 1367 - DNA, 1486 bp, Oligella urethralis
ttgatcctggctcagattgaacgctagcgggatgctttacacatgcaagtcgaacggcagcatgagagagcttgctctcttgatggcgagtggcggacgggtgagtaatgtatcggaacgtgcccggtagtgggggataactacgcgaaagcgtagctaataccgcatattctctacggaggaaagagggggatcgtaagacctcttgctaccggagcggccgatatcagattagctagttggtggggtaacggcctaccaaggcggtgatctgtagctggtttgagaggacgaccagccacactgggactgagacacggcccagactcctacgggaggcagcagtggggaattttcgacaatggggggaaccctgatcgagccatctcgcgtgtgggacgaaggccttcgggttgtaaaccacttttctcaacgaagaaaagtcttaggctaataccttaagatgctgacggtagttgaggaataagcaccggctaactacgtgccagcagccgcggtaatacgtagggtgcgagcgttaatcggaattactgggcgtaaagggtgcgcaggcggcttggaaagaacggtgtgaaatcccggggctcaacctcggaactgcactattaactgccaagctagagtatgtcagaggggggtggaattccgcgtgtagcagtgaaatgcgtagatatgcggaggaacaccgatggcgaaggcagccccctgggatggtactgacgctcaggcacgaaagcgtgggtagcgaacaggattagataccctggtagtccacgccctaaacgatgtcaactagctgttgggccggttacggcttagtagcgcagctaacgcgtgaagttgaccgcctggggactacggtcgcaagactaaaactcaaaggaattgacggggacccgcacaagcggtggatgatgtggattaattcgatgcaacgcgaaaaaccttacctacccttgacatgcccggaagcttcaagagattggagtgtgctcgcaagagaaccggagcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcaggacagcgggttgccaagccgcgaggtggagctaatctcttaaacctgatcgtagtccggattgcaggctgcaactcgcctgcatgaagtcggaatcgctagtaatcgcagatcagaatgctgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaa

SEQ ID NO: 1368 - DNA, 1327 bp, Olsenella genomosp. C1
gatgaacgctggcggcgcgcctaacacatgcaagtcgaacgagtggcgaacggctgagtaacacgtgggcaatctgccctttgcatcgggacagcctcgggaaaccgtggttaataccggatactgaaaggcggcaagggatgggcccgcgccctgttagcttgttggtggggtaaaagcctaccaaggcaatgatgggtagccgggttgagagaccgaccggccagattgggactgagacacggcccagactcctacgggaggcagcagtggggaatcttgcacaatgggcgaaagcctgatgcagcgacgccgcgtgcgggatgaaggccttcgggttgtaaaccgctttcagcagggacgatgacggtacctgcagaagaagccccggctaactatgtgccagcagccgcggtaatacgtagggagcaagcgttatccggattcattgggcgtaaagcgcgcgtaggctgcccagtaggtcgagagttaaatccgggggctcaacccccgtccgctcccgataccgctgggttcgagtctggtaggggaaggtggaattcccagtgtagcggtggaatgcgcagatattgggaagaacaccggtggcgaaggcggccttctgggccaactgacgctgaggcgcgaaagctaggggagcgaacaggattagataccctggtagtcctagccgtaaacgatgggcactaggtgtggggatttccgtgccgacgctaacgcattaagtgccccgcctggggagtacggccgcaaggctaaaactcaaaggaattgacgggggcccgcacaagcagcggagcatgtggcttaattcgaagcaacgcgaagaaccttaccagggcttgacactacaggtggtgcatggctgtcgtcagctcgtgtcgtgagatgttgggttaagtcccgcaacgagcgcaaccctcgtcgcatgttgccagcggccgggcacccatgcgagaccgccggcgttaagccggaggaaggtggggacgacgtcaagtcatcatgccctctatgtcctgggctgcacacgtgctacaatggccggcagcggggtgccactgcgcgagcacaagcgaatccctccggtcccagttcggatggaggctgcaacccgcctccagaagtcggagttgctagtaatcgcggatcagcacgccgcggtgaatgcgttcccgggccttgtacacaccgcccgtcacaccacccgagtcgtctgcacccgaagtcgtcgcctagggaggcgccgaaggtgtggaaggtaaggggggtgaagtcgtaacaaggtaaccgtaagagaacctgc

SEQ ID NO: 1369 - DNA, 1428 bp, Olsenella profusa
gatgaacgctggcggcgcgcctaacacatgcaagtcgaacggttaaagcatcttcggatgtgcataaagtggcgaacggctgagtaacacgtgggcaacctgcccctcgcatcgggacagcctcgggaaaccgtggttaataccggatactccgccacccccgcatgggggaggcgggaaagcccagacggcgagggatgggcccgcggcctgttagcttgttggtggggcagtggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgctaggtcgggagtcaaatccgggggctcaacccccgtccgctcccgataccggctggcttgagtctggtaggggaaggtggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtgggcggattgtccgtccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatctaggtgaagcggcggagacgccgtggccgagaggagcctagacaggtggtgcatggctgtcgtcagctcgtgtcgtgagatgttgggttaagtcccgcaacgagcgcaaccctcgtcgcatgttgccagcggttcggccgggcacccatgcgagaccgccggcgtcaagccggaggaaggtggggacgacgtcaagtcatcatgccccttatgtcctgggctgcacacgtgctacaatggccggcacaatgggctgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcaagggagggaggcgccgaaggtgtggaaggta

SEQ ID NO: 1370 - DNA, 1489 bp, Olsenella sp. F0004
gagtttgatcctggctcaggatgaacgctggcggcgcgcctaacacatgcaagtcgaacggttaaagccccttcgggggtgcatagagtggcgaacggctgagtaacacgtgggcaacctgccccccgcaccgggacagcctcgggaaaccgtggttaataccggatactccgccacccccgcatgggggcggcgggaaagcccaggcggagggggatgggcccgcggcctgttagctcgttggcggggtaacggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgaaaggtgacggtacctgcagaagaagccccggctaactacgtgccagcagccgcggtaatacgtagggggcgagcgttatccggattcattgggcgtaaagcgcgcgcaggcggcctgctcggtcgggagtcaaatccgggggctcaacccccgcccgctcccgataccggcgggcttgagtctggtaggggaaggcggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtggggggaggatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccgagaggagcccgcacaggtggtgcatggctgtcgtcagctcgtgtcgtgagatgttgggttaagtcccgcaacgagcgcaacccccgtcgcatgttgccagcggttaggccgggcacccatgcgagaccgccggcgtcaagccggaggaaggtggggacgacgtcaagtcatcatgccccttatgtcctgggctgcacacgtgctacaatggccggcacagcgggccgccaccgcgcgagcgggagcgaatccccaaagccggccccagttcggattggaggctgcaacccgcctccatgaagtcggagttgctagtaatcgcggatcagcacgccgcggtgaatgcgttcccgggccttgtacacaccgcccgtcacaccacccgagtcgtctgcacccgaagtcgccggcccaacccgcgagggggggaggcgccgaaggtgtggagggtaaggggggtgaagtcgtaacaaggtagccgtaccggaaggtgc

SEQ ID NO: 1371 - DNA, 1503 bp, Olsenella sp. oral taxon 809
agagttcgatcctggctcaggatgaacgctggcggcgcgcctaacacatgcaagtcgaacggttaagacgccttcgggcgtgtataaagtggcgaacggctgagtaacacgtgggcaacctgcccctcgcaccgggacagcctcgggaaaccgtggttaataccggatactccgcgcaccccgcatggggcgcgcgggaaagcccagacggcgagggatgggcccgcggcctgttagctagttggcggggcaacggcccaccaaggcgatgatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggtcgtaaaccgctttcagcagggacgaggccgcaaggtgacggtacctgcagaagaagccccggctaactacgtgccagcagccgcggtaatacgtagggggcgagcgttatccggattcattgggcgtaaagcgcgcgtaggcggcctgttaggtcgggagttaaatccgggggctcaacccccgtccgctcccgataccggcgggcttgagtctggtaggggaaggcggaattcccagtgtagcggtggaatgcgcagatattgggaagaacaccggtggcgaaggcggccttctgggccacgactgacgctgaggcgcgaaagctaggggagcgaacaggattagataccctggtagtcctagccgtaaacgatggacactaggtgtggggggacgatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatctaggtgaagcggcggagacgccgtggccgagaggagcctagacaggtggtgcatggctgtcgtcagctcgtgtcgtgagatgttgggttaagtcccgcaacgagcgcaaccctcgtcgcatgttgccagcggtccggccgggcacccatgcgagaccgccggcgtcaagccggaggaaggtggggacgacgtcaagtcatcatgccccttatgtcctgggctgcacacgtgctacaatggccggcacaatgggctgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcgagggggggaggcgccgaaggtgtggagggtaaggggggtgaagtcgtaacaaggtagccgtaccggaaggtgcggctggatcacct

SEQ ID NO: 1372 - DNA, 1503 bp, Olsenella uli
agagttcgatcctggctcaggatgaacgctggcggcgcgcctaacacatgcaagtcgaacggttaaagccccttcgggggtgcataaagtggcgaacggctgagtaacacgtgggcaacctgcccctcgcaccgggacagcctcgggaaaccgtggttaataccggatactcccgcacccccgcatgggggcgcggggaaagcccagacggcgagggatgggcccgcggcctgttagctcgttggcggggtaacggcccaccaaggcgatgatgggtagccgggttgagagaccgaccggccagattgggactgagacacggcccagactcctacgggaggcagcagtggggaatcttgcgcaatgggcggaagcctgacgcagcgacgccgcgtgcgggaaggaggccttcgggtcgtaaaccgctttcagcagggacgaggccgcgaggtgacggtacctgcagaagaagccccggctaactacgtgccagcagccgcggtaatacgtagggggcaagcgttatccggattcattgggcgtaaagcgcgcgtaggcggcctgttaggtcgggagtcaaatccgggggctcaacccccgcccgctcccgataccggcgggcttgagtctggcaggggaaggcggaattccaagtgtagcggtggaatgcgcagatatttggaagaacaccggtggcgaaggcggccttctgggccacgactgacgctgaggcgcgaaagctaggggagcgaacaggattagataccctggtagtcctagccgtaaacgatggacactaggtgtggggggacgatccctccgtgccgcagccaacgcattaagtgtcccgcctggggagtacggccgcaaggctaaaactcaaaggaattgacgggggcccgcacaagcagcggagcatgtggcttaattcgaagcaacgcgaagaaccttaccagggcttgacatccaggtgaagcggcggaaacgccgtggccggaaggagcctggacaggtggtgcatggctgtcgtcagctcgtgtcgtgagatgttgggttaagtcccgcaacgagcgcaacccccgtcgcatgttgccagcggtccggccgggcacccatgcgagaccgccggcgtcaagccggaggaaggtggggacgacgtcaagtcatcatgccccttatgccctgggctgcacacgtgctacaatggccggcacagcgggccgccaccgcgcgagcgggagcgaatccccaaagccggccccagttcggactggaggctgcaacccgcctccacgaagtcggagttgctagtaatcgcggatcagcacgccgcggtgaatgcgttcccgggccttgtacacaccgcccgtcacaccacccgagtcgtctgcacccgaagtcgtcggcccaacccgcgagggggggaggcgccgaaggtgtggagggtaaggggggtgaagtcgtaacaaggtagccgtaccggaaggtgcggctggatcacct

SEQ ID NO: 1373 - DNA, 1551 bp, Opitutus terrae
agagtttgatcctggctcagaatgaacgctggcggcgtggttaagacatgcaagtcgaacggtttttccggtgtagcaatacatcggaaagacagtggcgaacgggtgcgtaacacgtgaacaatctacctccaaatggggaatagctcggcgaaagccggattaataccgcatgtggttgcttctcgcatgagaggtataccaaagtcggggaccgcaaggcctgacgttaggagaggagttcgcggcctatcagctagttggcgaggtaacggctcaccaaggcaaagacgggtagctggtctgagaggatgatcagccacactggaactgagacacggtccagacacctacgggtggcagcagtttcgaatcattcacaatgggcgaaagcctgatggtgcgacgccgcgtgagggatgaaggtcttcggattgtaaacctctgtcaccggggaagaaacgctttatattaatcgtataaagcctgacttaacccggagaggaagcagtggctaactctgtgccagcagccgcggtaatacagagactgcgagcgttattcggattcactgggcgtaaagggtgcgcaggcggccgggtgtgtggggcgtgaaagcctggagcttaactccagaattgcgcctcaaactacacggctagagcattggagagggtagcggaattcacggtgtagcagtgaaatgcgtagatatcgtgaggaacaccagaggcgaaggcggctacctggacaattgctgacgctcaggcacgaaagcgtggggagcaaaagggattagatacccctgtagtccacgccctaaacggtgcacactaggtcttggcggattcgacccctccagggccccagctaacgcgttaagtgtgccgcctgaggactacggccgcaaggctaaaactcaaaggaattgacgggggcccgcacaagcggtggagtatgtggctcaattcgatgcaacgcgaagaaccttaccaagccttgacatgcattggacaggcgctgaaaggcgccctcccttcggggccggtgcacaggtgctgcatggctgtcgtcagctcgtgtcgtgagatgttgcgttaagtcgcgcaacgagcgcaacccctgtccttagttgccatcattcagttgggcactctagggagacaaaccctctttgagggtgggaaggtggggatgacgtcaagtcaggatggcccttacggcttgggctgcacacgtactacaatgcccggtacagagggacgcaataccgcgaggtggagcaaatcctcaaaaccgggcccagttcagattgtagtctgcaactcgactacatgaagttggaatcgctagtaatggcgcatcagctacggcgccgtgaatacgttcccgggccttgtacacaccgcccgtcacgtcatgaaagccggtttcgcccgaagtgcgtttgccaaccagcaatggaggcggcgccctaaggtgaggctggtgattgggacgaagtcgtaacaaggtagccgtaggggaacctgcggctggatcacctccttt

SEQ ID NO: 1374 - DNA, 1443 bp, Oribacterium sinus
ggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagaaagggagctgccgaaggcaggactgatgactggggtgaagtcgtaacaaggtagccgtatcggaaggtgcggctggatcacctcctt

SEQ ID NO: 1375 - DNA, 1378 bp, Oribacterium sp. ACB1
gatatgttatctagtggcggacgggtgagtaacacgtgggtaacctgccttatggagggggataacagagagaaatcactgctaataccgcataagcacacattgccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaaaccccgggctcaacctggggactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgttccaaaagaggaagctgccgaaaggcaggactgatgactggggtgaa

SEQ ID NO: 1376 - DNA, 1436 bp, Oribacterium sp. ACB7
  modified_base (45)..(45): a, c, t, g, unknown or other
  modified_base (164)..(164): a, c, t, g, unknown or other
gcggcgtgcctaacacatgcaagtcgaacgagatgcgtattgganagcttcggccggaagatgcgttatctagtggcggacgggtgagtaacacgtgggtaacctgccttatggagggggataacagagagaaatcactgctaataccgcataagcacacagtnccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggagtggcaagtctgaagtgaaaaccctgggcttaacctggggactgctttggaaactgttaatctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggagcaaagcttctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcattttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagagagggagctgccgaaggcaggactgatgactggggtgaa

SEQ ID NO: 1377 - DNA, 1372 bp, Oribacterium sp. CM12
gctcaggatgaacgctggcggcgtgcctaacacatgcaagtcgaacgagatgcttatcggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagtatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtc

SEQ ID NO: 1378 - DNA, 1425 bp, Oribacterium sp. ICM51
caggatgaacgctggcggcgtgcctaacacatgcaagtcgaacgagatgcgtatcggaaagcttcggccggaagatacgttatctagtggcggacgggtgagtaacacgtgggtaacctgccttatggagggggataacagagagaaatcactgctaataccgcataagcacacagtaccgcatggtacagggtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggtgcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtatgtaatgtactttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcagtgtcccaagaaagggagctgccga

SEQ ID NO: 1379 - DNA, 1259 bp, Oribacterium sp. OBRC12
tcaggatgaacgctggcggcgtgcctaacacatgcaagtcgaacgagtggcggacgggtgagtaacacgtgggtaacctgccttatggagggggataacagagagaaatcactgctaataccgcataagaaaagtcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagatgacagtacctgactaagaagccccggctaactacgtgccagcagccgcggtaatacgtagggggcaagcgttatccggatttactgggtgtaaagggagcgtagacggaatggcaagtctgaagtgaaatacccgggctcaacctgggaactgctttggaaactgttgttctagagtgttggagaggtaagtggaattcctggtgtagcggtgaaatgcgtagatatcaggaagaacaccggaggcgaaggcggcttactggacaaactgacgttgaggctcgaaagcgtggggatcaaacaggattagataccctggtagtccacgctgtaaacgatgaatactaggtgtcggggtctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcgacaggtggtgcatggttgtcgtcagctcgtgtcgtgagatgttgggttaagtcccgcaacgagcgcaacccctatagttagtagccagcatgggcactctaactagactgccagggataacctggaggaaggcggggatgacgtcaaatcatcatgccccttatgacttgggctacacacgtgctacaatggcgtacaaagggaagcaagagggtgaccttaagcaaatctcaaaacgtctcagttcggatgtagtctgcaacccgactacagaagctggaatcgctagtaatcgcagatcagcatgctgcggtgaatacgttcccgggtcttgtacacaccgcccgtcacaccatgggagttggtaatgcccgaagtcagt

SEQ ID NO: 1380 - DNA, 1523 bp, Oribacterium sp. oral taxon 078
aatgagagttcgatcctggctcaggatgaacgctggcggcgtgcctaacacatgcaagtcgaacggagtccagcctttaagaccttcgggtcaaagaggggaagactgagtggcggacgggtgagtaacacgtgggcaacctggctcatagagggggataacagagagaaatttctgctaataccgcataagcacacactgccacatggcagagggtgaaaagagaatcgctatgagatggacccgcgtctgattagccagttggcagggtaagagcctaccaaagcgacgatcagtagccgatctgagaggatgaacggccacattgggactgagacacggcccaaactcctacgggaggcagcagtgggggatattgcacaatggggggaaccctgatgcagcgacgccgcgtgagtgaagaagtatttcggtatgtaaagctctatcagcagggaagataatgacagtacctgaataagaagccccggctaactacgtgccagcagccgcggtaatacgtagggggcaagcgttatccggatttactgggtgtaaagggagcgtagacggaatggcaagtctgaagtgaaatgcccgggctcaacccgggaactgctttggaaactgtcgatctggagtgttggagaggtaagtggaattcctggtgtagcggtgaaatgcgtagagatcaggaagaacaccggaggcgaaggcggcttactggacaaagactgacgttgaggctcgaaagcgtgggaagcaaacaggattagataccctggtagtccacgccgtaaacgatgaatactaggtgtcggtctccgaaggagatcggtgccgacgcaaacgcaataagtattccacctggggagtacgttcgcaagaatgaaactcaaaggaattgacggggacccgcacaagcggtggagcatgtggtttaattcgaagcaacgcgaagaaccttaccaggtcttgagatcccgatgacagaagatgtaatgccttttcccttcggggcattggagacaggtggtgcatggttgtcgtcagctcgtgtcgtgagatgttgggttaagtcccgcaacgagcgcaacccttatcgtcagtagccagcagtaagatgggcactctgatgagactgccggggataacccggaggaaggcggggatgacgtcaaatcatcatgccccttatgacctgggcgacacacgtgctacaatggcggaaacagagggaagcgagggggcgacccggagcaaatctcaaaaataccgtctcagttcggactgcagtctgcaactcgactgcacgaagccggaatcgctagtaatcgcggatcagcatgccgcggtgaatccgttcccgggtcttgtacacaccgcccgtcacaccatgggagtcggtaatgcccgaagtcagtgacccaaaagagggagctgccgaaggcaggacagataactggggtgaagtcgtaacaaggtagccgtatcggaaggtgcggctggatcacctcctttct

SEQ ID NO: 1381 - DNA, 1497 bp, Oribacterium sp. oral taxon 102
gagtttgatcctggctcaggatgaacgctggcggcgtgcctaacacatgcaagtcgaacggggttctatatcggaagttttcggatggaagagataggacccagtggcggacgggtgagtaacacgtgggtaacctgcctcatagagggggataacagagagaaatcactgctaataccgcataagcacacgggatcgcatgatcctgggtgaaaagatttatcgctatgagatggactcgcgtctgattagctggttggcggggtaaaggcccaccaaggcgacgatcagtagccgatctgagaggatggccggccacattgggactgagacacggcccagactcctacgggaggcagcagtgggggatattgcacaatggagggaactctgatgcagcaacgccgcgtgagtgaagaagtatttcggtatgtaaagctctatcagcagggaagatgatgacagtacctgaataagaagccccggctaactacgtgccagcagccgcggtaatacgtagggggcaagcgttatccggatttactgggtgtaaagggagcgtagacggcgaagcaagtctgaagtgaaaatccggggctcaactccggaagtgctttggaaactgttttgatagagtgtcggagaggtaagtggaattcctggtgtagcggtgaaatgcgtagatatcaggaagaacaccggaggcgaaggcggcttactggacgataactgacgttgaggctcgaaagcgtgggaagcaaacaggattagataccctggtagtccacgccgtaaacgatgaatactaggtgtcgggggcgaagcccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgacagagcatgtaatgtgctttcccctcggggcaatggagacaggtggtgcatggttgtcgtcagctcgtgtcgtgagatgttgggttaagtcccgcaacgagcgcaacccctatattcagtagccagcagtaagatgggcactctggagagactgccagggataacctggaggaaggcggggatgacgtcaaatcatcatgccccttatgacttgggcgacacacgtgctacaatggcgtaaacaaagggaagcgagctcgcgagagtaagcgaaactcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagtcggtaatgcccgaagccagtgaaccaagagagggagctgtcgaaggcaggactgataactggggtgaagtcgtaacaaggtagccgtatcggaaggtgc

SEQ ID NO: 1382 - DNA, 1527 bp, Oribacterium sp. oral taxon 108
tttattatgagagttcgatcctggctcaggatgaacgctggcggcgtgcctaacacatgcaagtcgaacgagatgcgtatcggaaagcttcggccggaagatacgttatctagtggcggacgggtgagtaacacgtgggtaacctgccttatggagggggataacagagagaaatcactgctaataccgcataagcacacattgccgcatggcagagtgtgaaaagatttatcgccataagatggacccgcgtctgattagccagttggcagggtaaaagcctaccaaagcaacgatcagtagccgatctgagaggatgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtagacggaatggcaagtctgaagtgaaaaccctgggctcaacctggggactgctttggaaactgttgttctagagtgttggagaggtaagtggaattcttggtgtagcggtgaaatgcgtagatatcaggaagaacaccggaggcgaaggcggcttactggacaataactgacgttgaggctcgaaagcgtggggatcaaacaggattagataccctggtagtccacgctgtaaacgatgaatactaggtgtcggggagcaaagcatctcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgagatcccattgacagagtgtgtaatgcattttcccttcggggcaatggtgacaggtggtgcatggttgtcgtcagctcgtgtcgtgagatgttgggttaagtcccgcaacgagcgcaacccctatagttagtagccagcagtaagatgggcactctaactagactgccagggataacctggaggaaggcggggatgacgtcaaatcatcatgccccttatgacttgggctacacacgtgctacaatggcgtaaacaaagggaagcaagagggtgaccttaagcaaatctcaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaagtcaatgttccaagagaggaagctgccgaaggcaggactgatgactggggtgaagtcgtaacaaggtagccgtatcggaaggtgcggctggatcacctcctttct

SEQ ID NO: 1383 - DNA, 1506 bp, Orientia tsutsugamushi
tcaaacttaagagtttgatcctggctcagaacgaacgctggcggcatgcctaacacatgcaagtcgaacgaattaatgctgagcttgcttagcattaattagtggcaaacgggtgagtaacacgtgggaatctgcccatcagtacggaataacatttagaaataagtgctaataccgtatgccctctacaaggaggaaagatttatcgctgatggatgagcccgcggcagattaggtagttggtaaggtaatggcttaccaagcctgtgatctgtagctggtctgagaggacgaacagccacactgggactgagacacggcccagactcctacggggggcagcagtggggaatattggacaatgggcgaaagcctgatccagcaatgccgcgtgagtgatgaaggccttagggttgtaaagctcttttagtagggatgataatgacagtacctacagaaaaagccccggctaactccgtgccagcagccgcggtaagacggagggggctagcgttgttcggaattactgggcgtaaagggcgcgtaggcggtttaataagttaggagtgaaatcccggggcttaaccctggaactgcttctaaaactgttaggctagagtgtggtagaggatgatggaatttctagtgtagaggtaaaattcttagatattagaaggaacaccagtggcgaaagctgtcatctgggccattactgacgctgaggcgcgaaagcgtggggagcaaacaggattagataccctggtagtccacgctgtaaacgatgagtgctagatattgggggatttttctttcagtttcgtagctaacgcattaagcactccgcctggggagtacggtcgcaagattaaaactcaaaggaattgacgggggcccgcacaagcggtggagcatgcggtttaattcgatgatccgcgaaaaaccttaccaactcttgacatggtagtcgcgaaaaatggagacatttttcttcagtttggctggactacacacaggtgttgcatggctgtcgtcagctcgtgtcgtgagatgttgggttaagtcccgcaacgagcgcaacccttattcttatttgccagcgggtaatgccgggaactataggaaaactgccggtgctaagccggaggaaggtggggatgaggtcaagtcatcatggcccttatgagttgggctacacgcgtgctacaatggtacctacagaatgatgcaatacggtaacgtggagctaatcattaaaaggtatctcagttcggattgcactctgcaactcgagtgcatgaagtcggaatcgctagtaatcgcggatcagcatgccgcggtgaatacgttctcgggccttgtacacactgcccgtcgcaccatgggagtcagtggtacctgaagttggtgagctaacgtaagaggcagctaaccacggtagaactggtgactggggtaaagtcgtaacaaggtagccgtaggggaacctgcggctggattacctccttt

SEQ ID NO: 1384 - DNA, 1451 bp, Ornithinibacillus bavariensis
ccttcggggtgaaagtagtggatcgagcggcggacgggtgagtaacacgtgggcaacctgcctgtaagactgggataactcgcggaaacgcgagctaataccggataatactttttatcacatggtaagaagatgaaaggcggcgtaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtacaagagtaactgcttgtaccttgacggtacctaaccagaaagccccggctaactacgtgccagcagccgcggtaatacgtagggggcgagcgttgtccggaattattgggcgtaaagcgcgcgcaggcggttctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggccgcacaagcggtggagcatgtggtttaattcgaagcaacgcgaagaaccttaccaggtcttgacatcctctgaccaccctagagatagggctttcccttcggggacagagagacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaaggtagccgtgtcga

SEQ ID NO: 1385 - DNA, 1504 bp, Ornithinibacillus sp. 7-10AIA
tggctcaggacgaacgctggcggcgtgcctaatacatgcaagtcgagcgagtgaaattaactgatcccttcggggtgacgttaatggatctagcggcggacgggtgagtaacacgtgggcaacctgcctgtaagactgggataactcgcggaaacgtgagctaataccggataacacttcgaaccacatggtttgaagatgaaaggcggcgcaagctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttgttagggaagaacaagtacaatagtaactgattgtaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgaccaccctagagatagggctttcccttcggggacagagtgacaggtggtgcatggttgtcgtcagctcgtgtcgtgagatgttgggttaagtcccgcaacgagcgcaacccttattcttagttgccagcatttagttgggcactctaaggagactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgcctaaggtgggaccaatgattggggtgaagtcgtaacaa

SEQ ID NO: 1386 - DNA, 1420 bp, Oscillibacter sp. G2
  modified_base (72)..(72): a, c, t, g, unknown or other
ggacctggctcaggacgaacgctggcggcgtgcttaacacatgcaagtcgaacggagcacccttgaatgagntttcggycaaaggaaaggaatgcttagtggcggactggtgagtaacgcgtgaggaacctgcctttcagagggggacaacagctggaaacggctgctaataccgcatgacgcattcggatggcatcatctgaatgccaaagatttatcgctgaaagatggcctcgcgtctgattagatagttggcggggtaacggcccaccaagtcgacgatcagtagccggactgagaggttgaccggccacattgggactgagatacggcccagactcctacgggaggcagcagtggggaatattgggcaatgggcgcaagcctgacccagcaacgccgcgtgaaggaagaaggctttcgggttgtaaacttcttttaagagggaagagcagaagacggtacctcttgaataagccacggctaactacgtgccagcagccgcggtaatacgtaggtggcaagcgttgtccggatttactgggtgtaaagggcgtgcagccgggtgygcaagtcagatgtgaaatctcagggctcaaccctgaaactgcatttgaaactgtgygtcttgagtgccggagaggtaatcggaattccttgtgtagcggtgaaatgcgtagatataaggaagaacaccagtggcgaaggcggattactggacggtaactgacggtgaggcgcgaaagcgtggggagcaaacaggattagataccctggtagtccacgctgtaaacgatcaatactaggtgtgcggggactgaccccctgcgtgccggagttaacacaataagtattgcacctggggagtacgatcgcaaggttgaaactcaaaggaattgacgggggcccgcacaagcggtggattatgtggtttaattcgaagcaacgcgagaaccttaccaggtcttgacatcctgctacgagtagagatacatcaggtgcccttcggggaaagcagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgacctgggctacacacgtaatacaatggcggagaacaaagggatgcaaagccgcgaggcagagcgaaccccaaaaagccgtcccagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaacc

SEQ ID NO: 1387 - DNA, 1534 bp, Oscillibacter valericigenes
atttatagagagtttgatcctggctcaggacgaacgctggcggcgtgcttaacacatgcaagtcgaacggagcacccttgattgaggtttcggccaaatgagaggaatgcttagtggcggactggtgagtaacgcgtgaggaacctgcctttcagagggggacaacagttggaaacgactgctaataccgcatgatacatttgggcgacatcgcttgaatgtcaaagatttatcgctgaaagatggcctcgcgtctgattagatagttggtgaggtaacggcccaccaagtcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagtagaagacggtaccccttgaataagccacggctaactacgtgccagcagccgcggtaatacgtaggtggcaagcgttgtccggatttactgggtgtaaagggcgtgtagccgggaaggtaagtcagatgtgaaatctgggggctcaacctccaaactgcatttgaaactacttttcttgagtatcggagaggtaatcggaattccttgtgtagcggtgaaatgcgtagatataaggaagaacaccagtggcgaaggcggattactggacgacaactgacggtgaggcgcgaaagcgtggggagcaaacaggattagataccctggtagtccacgctgtaaacgatcaatactaggtgtgcggggactgaccccctgcgtgccgcagttaacacaataagtattgcacctggggagtacgatcgcaaggttgaaactcaaaggaattgacgggggcccgcacaagcggtggattatgtggtttaattcgaagcaacgcgaagaaccttaccaggacttgacatcctactaacgaggtagagatacgtcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggatgcaaagccgtgaggtggagcgaacccctaaaagccgtctcagttcggatcgcaggctgcaactcgcctgcgtgaagtcggaatcgctagtaatcgcggatcagaatgccgcggtgaatacgttcccgggccttgtacacaccgcccgtcacaccatgagagtcgggaacacccgaagtccgtagcctaacagcaatgagggcgcggccgaaggtgggtttgataattggggtgaagtcgtaacaaggtagccgtatcggaaggtgcggctggatcacctcctttcta

SEQ ID NO: 1388 - DNA, 1450 bp, Oscillospira guilliermondii
gacgaacgctggcggcgtgcttaacacatgcaagtcgaacggagcgccaaggaaggagttttcggacaacggatttggctgcttagtggcggactggtgagtaacgcgtgaggaacctgcccttgagtgggggacaacggttggaaacgactgctaataccgcatgatgtattgtcgggacatcccggcgataccaaagatttatcgctcaaggatggcctcgcgtctgattagatagttggtgaggtaacggctcaccaagtcgacgatcagtagccggactgagaggttggccggccacattgggactgagatacggcccagactcctacgggaggcagcagtggggaatattgggcaatggacgcaagtctgacccagcaacgccgcgtgaaggaagaaggctttcgggttgtaaacttcttttaagggggaagagcagaagacggtaccccttgaataagccacggctaactacgtgccagcagccgcggtaatacgtaggtggcgagcgttgtccggatttactgggtgtaaagggcgtgcagccgggtctgcaagtcagatgtgaaatccacgggcttaacccgtgaactgcatttgaaactgcgggtcttgagtatcggagaggtaatcggaattcctggtgtagcggtgaaacgcgtagatatcaggaagaacaccagtggcgaaggcggattactggacgacaactgacggtgaggcgcgaaagcgtggggagcaaacaggattagataccctggtagtccacgctgtaaacgatcaatactaggtgtgcggggactaacccctcgcgtgccggagtcaacacaataagtattgcacctggggagtacgatcgcaaggttgaaactcaaaggaattgacgggggcccgcacaagcggtggattatgtggtttaattcgaagcaacgcgaagaaccttaccaaggcttgacatggagaggctcggcttagagataggtctttcccttcggggacttctcacacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcttgggctacacacgtaatacaatggcggatacaaagggatgcgaaaccgcgaggtggagcgaaccccgaaaagccgtctcagttcggatcgcaggctgcaacccgcctgcgtgaagtcggaatcgctagtaatcgtgggtcagcataccacggtgaatacgttcccgggccttgtacacaccgcccgtcacaccatgagagtcgggaacacccgaagtccgtagcctaaccgcaaggggggcgcggccgaaggtgggttcgataattggggtg

SEQ ID NO: 1389 - DNA, 1539 bp, Oxalobacter formigenes
tgaactgaagagtttgatcctggctcagattgaacgctggcggcatgctttacacatgcaagtcgaacggcagcatgggggcaaccctgatggcgagtggcgaacgggtgagtaatatatcggaacgtacccaagagtgggggacaaccagtcgaaagattggctaataccgcatacgatctaaggatgaaagtgggggaccttcgggcctcacgctcctggagcggccgatagctgattagctagttggtggggtaaaggcctaccaaggcgatgatcagtagctggtctgagaggacgatcagccacactgggactgagacacggcccagactcctacgggaggcagcagtggggaattttggacaatgggggaaaccctgatccagcaatgccgcgtgagtgaagaaggccttcgggttgtaaagctcttttgtcagggaagaaattgattgggctaatatcccgattagatgacggtacctgaagaataagcaccggctaactacgtgccagcagccgcggtaatacgtagggtgcgagcgttaatcggaattactgggcgtaaagcgtgcgcaggcggttgtgtaagacagatgtgaaatgcccgggctcaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtcgactagttgttgggtcttaattgacttagtaacgcagctaacgcgtgaagtcgaccgcctggggagtacggtcgcaagattaaaactcaaaggaattgacggggacccgcacaagcggtggatgatgtggattaattcgatgcaacgcgaaaaaccttacctacccttgacatgtcaggaatcccgaagagatttgggagtgctcgaaagagagcctgaacacaggtgctgcatggctgtcgtcagctcgtgtcgtgagatgttgggttaagtcccgcaacgagcgcaacccttgtcattagttgctacgaaagggcactctaatgaaactgccggtgacaaaccggaggaaggtggggatgacgtcaagtcctcatggcccttatgggtagggcttcacacgtcatacaatggtgcatacagagggttgccaacccgagagggggagctaatctcagaaagtgcatcgtagtccggattgaagtctgcaactcgacttcatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttctagaga

SEQ ID NO: 1390 - DNA, 1523 bp, Paenibacillus barcinonensis
aacgctggcggcatgcctaatacatgcaagtcgagcggacttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaaggtagccgtatcggaaggtgcggctggatcacctcttt

SEQ ID NO: 1391 - DNA, 931 bp, Paenibacillus barengoltzii
  modified_base (891)..(891): a, c, t, g, unknown or other
gcggagtttatcgggagcttgctcctgataaacttagcggcggacgggtgagtaacacgtaggcaacctgcccgtaagactgggataactaccggaaacggtagctaataccggatacgcaagtctctcgcatgaggggcttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccgttagagtaactgctaacggagtgacggtacctgagaagaaagccccggctaactacgtgccagcagccgcggtaatacgtagggggcgagcgttgtccggaattattgggcgtaaagcgcgcgcaggcggctgtttaagtctggtgtttaatcctggggctcaaccccgggtcgcactggaaactggacagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggngtatgtggtttaattcgaagcaacgcgaagaaccttacca

SEQ ID NO: 1392 - DNA, 968 bp, Paenibacillus chibensis
gcggacttgatggagagcttgctctcctgatggttagcggcggacgggtgagtaacacgtaggcaacctgcctgcaagaccgggataacccacggaaacgtgagctaataccggatatctcatttcctctcctgagggaatgatgaaagacggagcaatctgtcacttgcggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccggtagagtaactgctatcggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaggccaaggctcaaccttggttcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacc

SEQ ID NO: 1393 - DNA, 1408 bp, Paenibacillus cookii
  modified_base (8)..(8): a, c, t, g, unknown or other
cggagttngttttgaaagcttgctttcaaaacaacttagcggcggacgggtgagtaacacgtaggcaacctgccccttagactgggataactaccggaaacggtagctaataccggataatttcttttttctcctgaaggaagaatgaaagacggagcaatctgtcactgagggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctaaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgaggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagc

SEQ ID NO: 1394 - DNA, 1455 bp, Paenibacillus durus
  modified_base (103)..(103): a, c, t, g, unknown or other
  modified_base (141)..(142): a, c, t, g, unknown or other
agcggcggacgggtgagtaacacgtaggcaacctgccccttggactgggataactaccggaaacggtagctaataccggataattcctcttagctcctgctangaggctgaaaggcggagcaatctgtcaccaagggatgnncctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctgtttaagtctggtgtttaaaccatgggctcaacctgtggtcgcactggaaactggacagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcgtctagagatgatggcgcggccttcgggacagaggagacaggtggtgcatggttgtcgtcagctcgtgtcgtgagatgttgggttaagtcccgcaacgagcgcaacccttgactttagttgccagcaggtcaagctgggcactctagagtgactgccgagtgacaaaccggaggaaggtggggatgacgtcaaatcatcatgccccttatgacctgggctacacacgtactacaatggccggtacaacgggaagcgaagcgcgaggcgggagccaatcttagaaagccggtctcagttcggattgcaggctgcaactcgcctgcatgaagtcggaattgctagctaatcgcggatcagcatgccgcggtgcaatgacgttcccgggtcttgtacacaccgcccgtcacaccacgagagtttacaacacccgaagtcggtggggtaaccgcaaggagccagccgccgaagtggggtagatgattggggtgaagtcgtaacaaggtagccgtatcggaaggtgcggctggatcacctcc

SEQ ID NO: 1395 - DNA, 1440 bp, Paenibacillus glucanolyticus
  modified_base (179)..(179): a, c, t, g, unknown or other
  modified_base (198)..(198): a, c, t, g, unknown or other
  modified_base (446)..(446): a, c, t, g, unknown or other
  modified_base (532)..(532): a, c, t, g, unknown or other
  modified_base (535)..(535): a, c, t, g, unknown or other
  modified_base (595)..(595): a, c, t, g, unknown or other
  modified_base (597)..(597): a, c, t, g, unknown or other
  modified_base (729)..(729): a, c, t, g, unknown or other
  modified_base (818)..(818): a, c, t, g, unknown or other
  modified_base (902)..(902): a, c, t, g, unknown or other
  modified_base (953)..(953): a, c, t, g, unknown or other
  modified_base (966)..(966): a, c, t, g, unknown or other
  modified_base (1072)..(1072): a, c, t, g, unknown or other
  modified_base (1125)..(1125): a, c, t, g, unknown or other
  modified_base (1363)..(1363): a, c, t, g, unknown or other
  modified_base (1400)..(1400): a, c, t, g, unknown or other
gagagtttgatcctggctcaggacgaacgctggcggcgtgcctaatacatgcaagtcgagcggacttgatggagtgcttgcactcttgagagttagcggcggacgggtgagtaacacgtaggcaacctgccctcaagactgggataactaccggaaacggtagctaataccggataatntattacatagcattatgtnataatgaaagacggagcaatctgtcacttggggatgggcctgcggcgcattagctagttggtggggtaacggcccaccaaggcgacgatgcgtagccgacctgagagggtgaacggccacactgggactgagacacggcccagtctcctacgggaggcagcagtagggaatcttccgcaatgggcgaaaaactgacggagcaacgccgcgtgagtgatgaaggttttcggatcgtaaagctctgttgncaaggaagaacgtcttctagagtaactgttatgagagtgacggtacttgagaagaaagccccggctaactacgtgccagcagccgnggnaatacgtagggggcaagcgttgtccggaattattgggcgtaaagcgcgcgcaggcggtcntntaagtctggtgtttaaacccggggctcaacttcgggtcgcactggaaactgggggacttgagtgcagaagaggagagtggaattccacgtgtagcggtgaaatgcgtagatatgtggaggaacaccagtggngaaggcgactctctgggctgtaactgacgctgaggcgcgaaagcgtggggagcaaacaggattagataccctggtagtccacgccgttnaaacgatgaatgctaggtgttaggggtttcgatacccttggtgccgaagttaacacattaagcattccgcctggggagtacggncgcaagcactgaaactcaaaggaattgacggggacccgcacaagcagtggngtatgtggtttanttcgaagcaacgcgaagaaccttaccaagtcttgacatccctctgaatctgctagagatagaggcggccttcgggacagaggagacaggtggtgcatggttgtcgncagctcgtgtcgtgagatgttgggttatgtcccgcaacgagcgcaacccttgnttttagttgccagcactaagggtgggcactctagaatgactgccggtgacaaaccggaggaaggcggcgtatgacgtcaaatcatcatgccccttatgacttgggctacacacgtactacaatggctggtacaacgggaagcgaagccgcgaggtggagccaatcctataaaagccagtctcagctcggattgcaggctgcaactcgcctgcatgaagtcggaattgctagtaatcgnggatcagcatgccgcggtgaatacgttcccgggtctngtacacaccgcccgtcacaccacgagagtttacaacaccc

SEQ ID NO: 1396 - DNA, 1395 bp, Paenibacillus lactis
ggagtgcttgcactcctgagatttagcggcggacgggtgagtaacacgtaggcaacctgccctcaagactgggataactaccggaaacggtagctaataccggataggatatttggctgcatggccgaatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagagagagtaactgctctttgggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaagcttaccaggtcttgacatccctttgacccctctagagatagaggtttccttcgggacagaggagacaggtggtgcatggttgtcgtcagctcgtgtcgtgagatgttgggttaagtcccgcaacgagcgcaacccttgatcttagttgccagcacgtaatggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagcca

SEQ ID NO: 1397 - DNA, 1505 bp, Paenibacillus lautus
  modified_base (1118)..(1118): a, c, t, g, unknown or other
cgaacgctggcggcgtgcctaatacatgcaagtcgagcggacttgatggagtgcttgcactcctgaaggttagcggcggacgggtgagtaacacgtaggcaacctgccctcaagactgggataactaccggaaacggtagctaataccggataatttatttcacagcattgtggaataatgaaagacggagcaatctgtcacttggggatgggcctgcggcgcattagctagttggtggggtaacggcccaccaaggcgacgatgcgtagccgacctgagagggtgaacggccacactgggactgagacacggcccagactcctacgggaggcagcagtagggaatcttccgcaatgggcgaaagcctgacggagcaacgccgcgtgagtgatgaaggttttcggatcgtaaagctctgttgccaaggaagaacgtcttctagagtaactgctaggagagtgacggtacttgagaagaaagccccggctaactacgtgccagcagccgcggtaatacgtagggggcaagcgttgtccggaattattgggcgtaaagcgcgcgcaggcggttctttaagtctggtgtttaaacccgaggctcaacttcgggtcgcactggaaactgggggacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaagtcttgacatccctctgaatcctctagagatagaggcggccttcgggacagaggtgacaggtggtgcatggttgtcgtcagctcgtgtcgtgagatgttgggttaagtcccgcaacgagcgcaacccttgattttagttgccagcacttngggtgggcactctagaatgactgccggtgacaaaccggaggaaggcggggatgacgtcaaatcatcatgccccttatgacttgggctacacacgtactacaatggctggtacaacgggaagcgaagccgcgaggtggagccaatcctataaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaagg

SEQ ID NO: 1398 - DNA, 1500 bp, Paenibacillus pabuli
  modified_base (77)..(77): a, c, t, g, unknown or other
gatcctggctcaggacgaacgctggcggcatgcctaatacatgcaagtcgagcggagttgagagaaagcttgctttnttgatacttagcggcggacgggtgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtcgtaacaag

SEQ ID NO: 1399 - DNA, 1491 bp, Paenibacillus polymyxa
gacgaacgctggcggcgtgcctaatacatgcaagtcgagcggggttaattagaagcttgcttctaactaacctagcggcggacgggtgagtaacacgtaggcaacctgcccacaagactgggataactaccggaaacggtagctaatacccgatgcctccttttcctgcatgggagaaggaggaaaggcggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagagcgaaggagcgatctggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaa

SEQ ID NO: 1400 - DNA, 968 bp, Paenibacillus popilliae
  modified_base (51)..(52): a, c, t, g, unknown or other
  modified_base (54)..(54): a, c, t, g, unknown or other
  modified_base (59)..(59): a, c, t, g, unknown or other
  modified_base (112)..(112): a, c, t, g, unknown or other
  modified_base (114)..(114): a, c, t, g, unknown or other
cccggctaactacgtgccagcagccgcggtaatacgtagggggcaagcgtnntncgganttattgggcgtaaagcgcgcgcaggcggtcatttaagtctggtgtttaaaccntngggctcaacctaaggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccctctgaatccactagagatagtggcggccttcgggacagaggagacaggtggtgcatggttgtcgtcagctcgtgtcgtgagatgttgggttaagtcccgcaacgagcgcaacccttaactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccatcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccg

SEQ ID NO: 1401 - DNA, 1496 bp, Paenibacillus sp. CIP 101062
tacatgcaagtcgagcggagttaatcgggagcttgctcctggttgacttagcggcggacgggtgagtaacacgtaggcaacctgcccgtaagaccgggataactagcggaaacgttagctaataccggataatcaagtttctcgcatgggggacttgggaaaggcggagcaatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgaagaaggttttcggatcgtaaagctctgttgccagggaagaacgtccgctagagtaactgctagcggagtgacggtacctgagaagaaagccccggctaactacgtgccagcagccgcggtaatacgtagggggcaagcgttgtccggaattattgggcgtaaagcgcgcgcaggcggctatttaagtctggtgtttaatcctggggctcaaccccgggtcgcactggaaactgggtggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtacagagatgtacctttccttcgggacaggggagacaggtggtgcatggttgtcgtcagctcgtgtcgtgagatgttgggttaagtcccgcaacgagcgcaacccttgactttagttgccagcaggtcaagctgggcactctagagtgactgccggtgacaaaccggaggaaggtggggatgacgtcaaatcatcatgccccttatgacctgggctacacacgtactacaatggctggtacaacgggaagcgaaggagcgatccggagcgaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggttggatcacc

SEQ ID NO: 1402 - DNA, 965 bp, Paenibacillus sp. HGF5
  modified_base (913)..(913): a, c, t, g, unknown or other
ggagtgcttgcactcctgagatttagcggcggacgggtgagtaacacgtaggcaacctgccctcaagactgggataactaccggaaacggtagctaataccggataggatatttggctgcatggccgaatatggaaaggcggagcaatctgtcacttgaggatgggcctgcggcgcattagctagttggtggggtaatggcctaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgccagagagagtaactgctctttgggtgacggtacctgagaagaaagccccggctaactacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaancttaccaggtcttgacatccctttgacccctctagagatagaggtttccttc

SEQ ID NO: 1403 - DNA, 1556 bp, Paenibacillus sp. HGF7
ttatcggagagtttgatcctggctcaggacgaacgctggcggcgtgcctaatacatgcaagtcgagcggacttgatgagaagcttgcttctctgagagttagcggcggacgggtgagtaacacgtaggcaacctgcctgtaagatcgggataactaccggaaacggtagctaagaccggataatcggtatctccgcatggggagatcgtgaaacacggagcaatctgtggcttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgcaagtctgacggagcaacgccgcgtgagtgatgaaggttttcggatcgtaaagctctgttgccagggaagaacgccaaggagagtaactgctctttgggtgacggtacctgagaagaaagccccggctaactacgtgccagcagccgcggtaatacgtagggggcaagcgttgtccggaattattgggcgtaaagcgcgcgcaggcggttttttaagtctggtgtttaatcccgaggctcaacctcggttcgcaccggaaactgggagactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgcatgctaggtgttaggggtttcgatacccttggtgccgaagttaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccctctgaccggcttagagataagcctttccttcgggacagaggtgacaggtggtgcatggttgtcgtcagctcgtgtcgtgagatgttgggttaagtcccgcaacgagcgcaacccttgaacttagttgccagcaggttaagctgggcactctaagttgactgccggtgacaaaccggaggaaggcggggatgacgtcaaatcatcatgccccttatgacctgggctacacacgtactacaatggccggtacaacgggaagcgaaggagcgatctggagccaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggggccagccgccgaaggtggggtagatgattggggtgaagtcgtaacaaggtagccgtatcggaaggtgcggctggatcacctcctttct

SEQ ID NO: 1404 - DNA, 1434 bp, Paenibacillus sp. JC66
atcctggctcaggacgaacgctggcggcgtgcstaatacatgcaagtcgagcggagcatatcgcgatcttcggatggcaatacgcttagcggcgaacgggtgagtaacacgtaggcaacctgcctgtaagatcgggataacttgcggaaacgtgagctaataccggatgtgcttgagtccacgcctgtgggtttaaggaaagacggagcaatctgtcacttacagatgggcctgcggcgcattagctagttggtgaggtaacggctcaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaacgccaaggagagtaactgctctttgggtgacggtatctgagaagaaagccccggctaactacgtgccagcagccgcggtaatacgtagggggcaagcgttgtccggaattattgggcgtaaagcgcgcgcaggcggtgaattaagtctgatgtttaaacccggggctcaacctcgggtcgcattggaaactggttgactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccggtgcagagatgtgcctttccttcgggacagaggagacaggtggtgcatggttgtcgtcagctcgtgtcgtgagatgttgggttaagtcccgcaacgagcgcaacccttgatgctagttgccagcattcagttgggcactctaggatgactgccggtgacaaaccggaggaaggtggggatgacgtcaaatcatcatgccccttatgacctgggctacacacgtactacaatggccggtacaacgggcagcgaaggagcgatctggagcgaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtc

SEQ ID NO: 1405 - DNA, 1522 bp, Paenibacillus sp. R-27413
gacgaacgctggcggcgtgcctaatacatgcaagtcgagcggagcttagccttcctttggaaggctytggcttagcggcggacgggtgagtaacacgtaggcaacctgcccgtaagaccgggataacttgcggaaacgtgagctaataccggatagataggaagagcgcatgctyttcttaggaaagacggagcaatctgtcacttacggatgggcctgcggcgcattagctagttggtggggtaaaggcctaccaaggcgacgatgcgtagccgacctgagagggtgaccggccacactgggactgagacacggcccagactcctacgggaggcagcagtagggaatcttcggcaatggacggaagtctgaccgagcaacgccgcgtgagtgaagaaggttttcggatcgtaaaactctgttgccagagaagaaagctaaggagagtcactgctctttggttgacggtatctgagaagaaagccccggctaactacgtgccagcagccgcggtaatacgtagggggcaagcgttgtccggaattattgggcgtaaagcgcgcgcaggcggctgagtaagtctggtgtttaaacctggggctcaacctcgggtcgcattggaaactgcttggctggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgaatgctaggtgtcaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccgtyctagagatagggcttcccttcggggcagaggagacaggtggtgcatggttgtcgtcagctcgtgtcgtgagatgttgggttaagtcccgcaacgagcgcaacccttgatcttagttgccagcattgagttgggcactctaggatgactgccggtgacaaaccggaggaaggtggggatgacgtcaaatcatcatgccccttatgacctgggctacacacgtactacaatggccggtacaacgggcagcgaaggagcgatccggagcgaatcccaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgaaagtttacaacacctgaagtcggtgaggtaaccgcaaggagccagccgccgaaggtggggtagatgattggggtgaagtcgtaacaaggtagccgtatcggaaggtgcggctggatcacctcct

SEQ ID NO: 1406 - DNA, 1004 bp, Paenibacillus sp. R-27422
  modified_base (31)..(33): a, c, t, g, unknown or other
  modified_base (54)..(54): a, c, t, g, unknown or other
agagagagtaactgctctttgggtgacggtnnngagaagaaagccccggctaantacgtgccagcagccgcggtaatacgtagggggcaagcgttgtccggaattattgggcgtaaagcgcgcgcaggcggttctttaagtctggtgtttaaacccggagcttaacttcgggacgcactggaaactggggaacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgacccctctagagatagaggtttccttcgggacagaggagacaggtggtgcatggttgtcgtcagctcgtgtcgtgagatgttgggttaagtcccgcaacgagcgcaacccttgatcttagttgccagcacgtaatggtgggcactctaaggtgactgccggtgacaaaccggaggaaggtggggatgacgtcaaatcatcatgccccttatgacctgggctacacacgtactacaatggctggtacaacgggaagcgaagccgcgaggtggagccaatcctaaaaagccagtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaaccgcaaggagcca

SEQ ID NO: 1407 - DNA, 1515 bp, Paenibacillus sp. oral taxon F45
agagtttgatcctggctcaggacgaacgctggcggcatgcctaatacatgcaagtcgagcggagttgacgagaagcttgcttctctgatgcttagcggcggacgggtgagtaacacgtaggcaacctgcctttcagactgggataacttccggaaacggatgctaataccggatacatcgtttcttcgcatgaagagacgaggaaagacggcgcaagctgtcactgagagatggacctgcggcgcattagctagttggtggggtaatggcccaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtttcgtagagtaactgctgcggaagtgacggtacctgagaagaaagccccggctaactacgtgccagcagccgcggtaatacgtagggggcaagcgttgtccggaattattgggcgtaaagcgcgtgcaggcggcttcttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggccgcaaggctgaaactcaaaggaattgacggggacccgcacaagcagtggagtatgtggtttaattcgaagcaacgcgaagaaccttaccaggtcttgacatccctctgaccggtctagagatagaccttcccttcggggtagaggagacaggtggtgcatggttgtcgtcagctcgtgtcgtgagatgttgggttaagtcccgcaacgagcgcaacccttgactttagttgccagcatttcggatgggcactctagagtgattgccggtgacaaaccggaggaaggcggggatgacgtcaaatcatcatgccccttatgacctgggctacacacgtactacaatggccggtacagagggtcgcgaagccgcgaggtggagccaatcccagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgt

SEQ ID NO: 1408 - DNA, 1541 bp, Paenibacillus timonensis
gacgaacgctggcggcgtacctaatacatgcaagtcgagcggagttaatcgggagcttgctcctgattagcttagcggcggacgggtgagtaacacgtaggcaacctgcccgtaagactgggataactaccggaaacggtagctaataccggatacgcaaattcctcgcatgggggatttgggaaaggcggagcaatctgtcacttacggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcctctagagtaactgctaggggagtgacggtacctgagaagaaagccccggctaactacgtgccagcagccgcggtaatacgtagggggcgagcgttgtccggaattattgggcgtaaagcgcgcgcaggcggctgtttaagtctggtgtttaatcctggggctcaactccgggtcgcactggaaactgggcagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggccgcaaggctgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggttgggcactctagagtgactgccggtgacaaaccggaggaaggtggggatgacgtcaaatcatcatgccccttatggcctgggctacacacgtactacaatggccggtacaacgggaagcgaagccgcgaggtggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacctgagctaccccaaaaagtgaagattatgctgcgaagcgtattccgagtacttttcggggaccccggtttggagccagccgccgaaggtggggtagatgattggggtg

SEQ ID NO: 1409 - DNA, 1504 bp, Pantoea agglomerans
agagtttgatccctggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgtacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgta

SEQ ID NO: 1410 - DNA, 1542 bp, Pantoea ananatis
taaattgaagagtttgatcatggctcagattgaacgctggcggcaggcctaacacatgcaagtcggacggtagcacagaggagcttgctcctctggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 1411 - DNA, 1344 bp, Pantoea brenneri
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgyggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctygtagaggggggtagaattccaggtgtagcggtgaaatgcgtagagatctggaggaataccggtggcgaaggcggccccctggacraagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1412 - DNA, 1422 bp, Pantoea citrea
attgaacgctggcggcaggcctaacacatgcaagtcgaacggtagcacagaggagcttgctccttgggtgacgagtggcggacgggtgagtaatgtctgggaaactgcctgatggrgggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtcaggaggaagggtgtagtcttaaacggctatgcattgacgttactgacagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggygtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagatagcttaacct

SEQ ID NO: 1413 - DNA, 1344 bp, Pantoea conspicua
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1414 - DNA, 1344 bp, Pantoea septica
ggacgggtgagtaatgtctgggaaactgcccgatggagggggataactactggaaacggtagctaataccgcataacgtcgcragaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgyggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgtttccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgscagagatgscctggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacct

SEQ ID NO: 1415 - DNA, 1491 bp, Papillibacter cinnamivorans
  modified_base (449)..(449): a, c, t, g, unknown or other
  modified_base (454)..(454): a, c, t, g, unknown or other
  modified_base (589)..(589): a, c, t, g, unknown or other
  modified_base (1427)..(1427): a, c, t, g, unknown or other
gatcctggctcaggacgaacgctggcggcgtgcctaacacatgcaagtcgaacgaaaataccaaagcagcaatgcgggggtattttagtggcggacgggtgagtaacgcgtgagcaatctgccttttggagggggataccgactggaaacggtcgttaataccgcataacgtatatggacgacatcgtccgtataccaaaggagcaatccgccgaaagatgagctcgcgtctgattagctagttggcggggtaaaggcccaccaaggcgacgatcagtagccggactgagaggttgaacggccacattgggactgagatacggcccagactcctacgggaggcagcagtggggaatattgggcaatgggcgaaagcctgacccagcaacgccgcgtcaaggaagaaggccttcgggttgtaaacttcttttaccagggaagaagaagtncggtncctggaaaacaagccacggctatctacgtgccagcagccgcggtaatacgtaggtggcaagcgttgtccggatttactgggtgtaaagggcgcgtaggcggcattgcaagtcagatgtgaaatgccggggcttanccccggagctgcatttgaaactgtagagcttgagtgatggagaggcaggcggaattcctagtgtagcggtgaaatgcgtagatattaggaggaacaccagtggcgaaggcggcctgctggacattaactgacgctgaggcgcgaaagcgtggggagcaaacaggattagataccctggtagtccacgctgtaaacgatggatactaggtgtgggaggtctgaccccttccgtgccggagttaacacaataagtatcccacctggggagtacgatcgcaaggttgaaactcaaaggaattgacgggggcccgcacaagcagtggagtatgtggtttaattcgaagcaacgcgaagaaccttaccaggatttgacatcctactaacgaggtagagatacgtcaggtgcccttcggggaaagtagagacaggtggtgcatggttgtcgtcagctcgtgtcgtgagatgttgggttaagtcccgcaacgagcgcaacccttattgctagttgctacgcaagagcactctagcgagactgccgttgacaaaacggaggaaggcggggacgacgtcaaatcatcatgccccttatgtcctgggctacacacgtactacaatggcggttaacagagggaagcaagacagtgatgtggagcaaatccctaaaaaccgtctcagttcggatcgcaggctgcaacccgcctgcgtgaagtcggaattgctagtaatcgcggatcagcatgccgcggtgaatacgttcccgggccttgtacacaccgcccgtcacaccatgagagtcgggaatacccgaagtccgtagtctaaccgcaagggggacgcngccgaaggtaggttcgataattggggtgaagtcgtaacaaggtaaccgtatcggaaggtgcggc

SEQ ID NO: 1416 - DNA, 1349 bp, Parabacteroides distasonis
accgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacacagtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcagttcccgttggaaatgggagttttgagtatgttcgagtcaggcggaatgcgtggtttagcggtgaaatgctcaggaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaa

SEQ ID NO: 1417 - DNA, 1383 bp, Parabacteroides goldsteinii
aggggcagcacgatgtagcaatacattggtggcgaccggcgcacgggtgagtaacgcgtatgcaacctacctatcagaggggaataacccggcgaaagtcggactaataccgcataaaacaggggttccacatggaaatatttgttaaagaattatcgctgatagatgggcatgcgttccattagatagttggtgaggtaacggctcaccaagtccacgatggataggggttctgagaggaaggtcccccacactggtactgagacacggaccagactcctacgggaggcagcagtgaggaatattggtcaatgggcgagagcctgaaccagccaagtcgcgtgaaggatgaaggatctatggtttgtaaacttcttttatatgggaataaagtgaggaacgtgttcctttttgtatgtaccatatgaataagcatcggctaactccgtgccagcagccgcggtaatacggaggatgcgagcgttatccggatttattgggtttaaagggtgcgtaggtggttaattaagtcagcggtgaaagtttgtggctcaaccataaaattgccgttgaaactggttgacttgagtatatttgaggtaggcggaatgcgtggtgtagcggtgaaatgcatagatatcacgcagaactccgattgcgaaggcagcttactaaactataactgacactgaagcacgaaagcgtggggatcaaacaggattagataccctggtagtccacgcagtaaacgatgattactagctgtttgcgatacacagtaagcggcacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgcattcggaccggagtggaaacacttcttctagcaatagccgtttgcgaggtgctgcatggttgtcgtcagctcgtgccgtgaggtgtcggcttaagtgccataacgagcgcaacccttatcactagttactaacaggtcatgctgaggactctagtgagactgccagcgtaagctgtgaggaaggtggggatgacgtcaaatcagcacggcccttacatccggggcgacacacgtgttacaatggtggggacaaagggcagctaccgggcgacaggatgctaatctccaaaccccatctcagttcggatcgaagtctgcaacccgacttcgtgaagctggattcgctagtaatcgcgcatcagccatggcgcggtgaatacgttcccgggccttgtacacaccgcccgtcaagccatgggagttgggggtacctaaagtccgtaaccgcaaggatc

(The sequence listing continues in the following parts.)

What is claimed is:

1. A composition comprising a therapeutically effective amount of a population of bacterial spores, the population of bacterial spores comprising at least one isolated Clostridium disporicum spore comprising a 16S nucleic acid comprising a sequence at least 97% identical to SEQ ID NO:579, at least one isolated Blautia producta spore comprising a 16S nucleic acid comprising a sequence at least 97% identical to SEQ ID NO:379, and at least one isolated Coprococcus comes spore comprising a 16S nucleic acid comprising a sequence at least 97% identical to SEQ ID NO:674, wherein the population of bacterial spores can synergistically decrease and/or inhibit the growth and/or colonization of at least one species of pathogenic bacteria in a human gastro-intestinal tract.

2. The composition of claim 1, wherein the Clostridium disporicum spore comprises a 16S nucleic acid sequence comprising SEQ ID NO:579, and the Blautia producta spore comprises a 16S nucleic acid sequence comprising SEQ ID NO:379, and the isolated Coprococcus comes spore comprises a 16S nucleic acid sequence comprising SEQ ID NO:674.

3. The composition of claim 1, wherein the population of bacterial spores can synergistically inhibit Clostridium difficile growth in a CivSim assay with a confidence interval of >99%.

4. The composition of claim 1, wherein the pathogenic bacterium is a Clostridium.

5. A single dose unit comprising the composition of claim 1.

6. A pharmaceutical formulation comprising an effective amount of the composition of claim 1, and an effective amount of an anti-bacterial agent, an anti-fungal agent, an anti-viral agent or an anti-parasitic agent.

7. A method of functionally populating the gastrointestinal tract of a human subject, the method comprising administering to the subject an effective amount of the composition of claim 1.

8. A method for preventing, treating, reducing the severity of or reducing one or more symptoms of a dysbiosis of the gastrointestinal tract in a human subject, the method comprising administering to the subject an effective amount of the composition of claim 1.

9. A method of reducing the abundance of *C. difficile* in the gastrointestinal tract of a human subject, the method comprising administering to the subject an effective amount of the composition of claim 1.

10. A formulation comprising the composition of claim 1 and pharmaceutically acceptable excipient.

11. The composition of claim 1, wherein the composition is derived from fecal material subjected to ethanol treatment.

12. The composition of claim 1, comprising a delayed release capsule.

13. The composition of claim 1, formulated for oral administration.

14. The composition of claim 1, comprising at least $1\times10^4$ colony forming units of the purified population of bacterial spores per dose of the composition.

* * * * *